United States Patent 10,724,096 (METHODS AND COMPOSITIONS FOR INHIBITING AND TREATING NEUROLOGICAL CONDITIONS) - sequence listing, part 46

SEQ ID NO: 979 - DNA, 1380245 bp, Homo sapiens
tgtgcaaataatactgtgattcatgttcatgtgtagtggatgatcttgcttttttgtttttgttttttttttttttttgagacagagtctcactctgttgcccaggctggagttcagtggcgtgatctcggctcactgcaacctctgccccccgggttcaagtgattctcctgcctcagcctcccaggaagctgggattacaggtgcctgccaccacgcccagctaatttttgtatttttaatagagacggggtttcatcatcttggccaggctggtcttgaactcctgacctcgtgatccacccacctcggcctcccaaagtgctgggattacaggcatgagccaccgcgcccggcctgctctaacttattttaagaatcactgttctattctggaaagggaaaagaccaccaccaagaagggaaaggagaccatgctggacagcctaatagtctaacaggggatcctagggtgcctgagctcatgggagcaaaccttgttcaggcaccgcaagcccaacgcagcatgcagattgggaaggcgcaataatgcaaacaccatcaggaagaaagctatggatgatggaaaacactgtgtgctccacgtgacagaagggagccacctgatttgtcgcatcgggccagtgtaaggaagtgtaatttagtgggactgccagtgacactaagtcaggccttgatcagggtctggactcagtatggacacgagccactgggtgcagggggctcatgcctgccacctctctttttttcccttactatagagactttgatctgtccaccatttctatgtgagctttgggcttcctgtcacaggtctgttgtcaccgtggggccatgttggagtcggtagattttcagacagtgaagccacatgaagctgtgaatgctgatgtggctgctgcagagcccagtctctccccggtgcagggcctctgagacgacgggactgtcctcagatggttggaagaaatgggttatcttaggcagttaggaaaagagggacaggtgtcccaggatgtggaaaacttgagttcatcccctctcttccctccagcaaggatttcagtgctacatctaaaaagagaagccctgttgccgatttaataatttacagtctctaaatccaaaagggcctccatgtgctagtgagactcatgccctcagttatgttcacgatcttcctgagaagtcagacaatacaggtagaacaaaagatagtggttgtactttctcttctgcgtagtgtgggtaagagcatgcggtttgccgcatgcagtgttgttaatcttttgattgtgttgtgaatggctgaaaaaaaagctgaaagtttgattgaactgaaatccaatccatgtcaacataaggaatattctagtgagtttactgtcctaagagaaggtctctcctggggaacccctggtatgcagagctccctgggacttgcagattggacagagagggtgtgccaaaggggtataaacccttctgatggagagagtcgggcgtgtcttcattttggtagttctggaaaggctcctctttaaagattctgatttaataatgttcacttttgttaagattgaatatcattttgaaatcatttctaaacgtgtttcctttataggcactttatctattaaatttacagtggagccaaatgtattagcaaaatctccaagttgcaaaatgaatactcagaatcaaactatagattttttggtgatactttcagaaaaacaatttctttctaaagttgcaaatcatgaaagggaatgaaagtacattaacttgatttcttccctgtaattcaaacattcaacattcaaattaactttcataatttctcactttgtgacaagttgatttacgcatagttggtatttcattaatgcgatttatatagatggaattcttaaggataaacaaatgtttttgactattgcctggggttctttgggaatagatgctttctgaaaatttaaataagaacattactgttaaagccatgaatctagtttggagaacccactgcagttcattttacagagaaacaccttgtcaatggcatcttcatggtgtttactgaaggtaaaaggcaggatattaaatgtgagaactctctctccagctactgattctgcctgtctcgaattcaggtgagaatgacccatacagatacatggattgcacttgaatctgtgctctggtatttgtgtcatccggaggctgagaacgcctgttggtggtgtcgcagatggctctgctgtcttgtgtggacaaactgaaagggattcaggagcttcttctgtaattttactctgctgtttttcatggacatagtgaaagggatccaggagtttcttctgcaatttggctgtagttggactttgaaaaaaacttgaagagtgtgtgtgcgcgcgcgcgcgtgtgtgtgtgtgtttgaaaagagaattagaaaatgaaggtagacactgggtatgctcccccaggatgtggcgatggggcgcccggccgccctggctacacgtcgaaccagtggtcccccatgcagacgcggttccactcgcagccacagttccagcaccactcgagcctgcactggggctgcggacacttcatgtgcatgcagcctcctgttgggggcagaaaacaaaggtgtggtgggttcgcagcaagtacctggaaaacacgcattcccaaaccagcacgctagcctagacatcactttctgagcgaataatcacaagcaatacaagggcagagagaaacttaactgaggggaaaaacttcataaagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatatttttatatatttatatttaaaatatatataaatatatttttatatatttatatttaaaatatatataaatatatttatatttaaatatattgataaaatttgatgatataacctaatataatgtataataatttaaatatattttgatttatttttgctctttctatagtgccacttacttggcttggccaaattcataaaacaggaactgggatagcatattgtaattattattatttctatttttttttttgagatggagttttgctcttgtcgtccaggctggagtgcagtggcgagatcttggctcactgcaacccccacctcccaggttcaagtgattctctggcctcagcctcccgagtagctgggattacaggcgcccaccaacatgcccagctaatttttgaatttttcgtagagacagggttttgccatgttggccaggctggtctcaaactcctgacctcaagtcatcctcccgcctcggcctcccaaagtgctgggattacaggcgtgagctaccgcacccagccagcatattatttttaatagggaatatgttccttaatgctatccaaaattttaattaagatgagagggatagaaaggaagtaattaataatgctaggtgttctatgtatattatctcatttgcttcccaaagcactttgagataagagcatcactctgctatagaatttccccaaggtgaagcacttttaaatggtgaagacaatgatctcaccaaggtctgtgtgattccaatgtcctgtcattcacagaacaggttattttcagcataagaggaaaagtcccttatcttggaacttattttggaattattcacctccctcacttgttaaacatagactccatgagtttctggagtgcacacagccctgcttcagtcgctgtgggggaactgaagggaggaggaagtgatttgtatgaggatgtacagagaactgtttctgtccaaatttcctggaaaaccccggcaaacgcagtttctttgcttgaatcccacctagcgttgaaggtgctccattactcactcttaccaattatcttgttaattgatttttcctgccaaattttccaagtaattggttcggtgctgtctcacttttattattagaaacctggcatgagaactttcactaatttaaaatatttatgaatatataggaataggcatttgttttaagataacttgccgacatgcaaaatctcctgttttcctaatcctttctggcttgttttaaagatcataaattacagatctgtggaaaataaaggagaaaacttacaacacttttatcttcatactttccacttaggtttgtgccattttcagcacatattgcatggttgtatatttatgatgtaaataatatgttatatggtgtgacattataaaaccacttgtttctctaaaatatcataaatattttatcatatcataaatatatcattattatatcatgtatcgtaaaatatattcaatcaaaattattgagcaatacattaaaacttaatgaactattaaagcaattctaaatgaaagggtaagaaactttcctattgtgatatttaatatatataagcatatataaacacaaatatgtatgaagagtgtgtgtgtgtgtgtgtgtgtgtgtgtgtatatatatatatatattttattttattttattttatttttttgagatggagtctcgctctgtcgcccaggctggagtacagggcgcgatctgggctcactgccacctctgcctcccgggttcaagcaattctcctgcctcagcctctcgagtagttggaattacaggcacctgccaccacgcctggctaaattttgtatttttagtagagacggggtttcaccatgttgaccaggctggtctcaaactcctgacctcgtgatctgcctgccttggcctcccaaagtgctgggattacaggcatgagccaccgcgcctggctgatagatgtgtttttcatacacagtccctggcttataactcccatagctcttgttacagtcttttgtcataatgttggggcaattcaggcctcagaaacaggcgccagaaaagagaatctctccctccgacctttccttgccctccttttaccagcccagggcaggactggaaccatccgcagctgttctgactgtgggttataagacccggatttcagaaagagtcctgtccatcccctggaggaaggaatgctgcacagggaggccaagaagaatctagaccggcaggccttgcagggtctccccactccatcttttagcgtgagatcaaagcctttctgtcccaccgcatttcaacacggctgtccatgcttccatcgtgcctatcccaggaagtctccatagagggccccagaggacagggtttggggagcttccaggttgctgaacacatggaggtttctgatgggcggagcacccagggaaggcttggaagctccgcgacccttcccccatacctcgccctctgcatctcttcatctgtatcttttgtaatatcctttataataaactggtaaatgtgtttccctgagttctgtgagccactgtagcaaataacagaacccaaagagggagtcatgggaatctcaacttgaagccagtcgatcagaacttccggaagcccagacttgagaccggtgagtggcagtcctgtgggactgagcccccagcctgagggatcagacactatttcctggtagacagcgccagggttgaagagcaggacactcagccggtgtccactgcagaactgattgcttgcttggtgcgtggggaaaaacccccgcacattccgtcacagaagtcttctgtgctgactgttgttattgaatgagagaatagaagaagcatgttgtttgttctacacttagaccgaatgccaaaaattaataccaagcatttaatgaatctgggatactagcattgtaaatgatatcttggtacagaagctagaattacaatggcctggtacagtaagaatggaaatgggaagagaagatattcacgtcattagctttcttttctccctagggcttaatatacacaaggccatagagctagacccaggccatggaggagcatggaggaccgcaattctaaaagctttgccagcttaaaagtaagtgcatccaggaagcagctgaaacttcacgcagatttgtggatatagacatgaagggaatatggcttcctttgtagtgagttctgtctgcagatggacactcaaaccatgaaaagctcagcctacgccgggcagtcgacatcgtggctccggccagcaattcttccactagatttaatgagagcgtggaagtccctgaacaacctgaaggcacatttgaggagaagcacacactcagtcagggaatggagccagaatttcatctgcttgagatggaagtgaagaaatttctggagactggagtggattataggagaaagtaccagggtttagcctgtgcttaaaatggaaattcctcgcattctcatttcagcttctctgagggaggaagggcattcctgaaacacagctgagtatgtaacaggccacgaaccttggtgacaaccaggtaacatccttggtcatagaggctatgtcggtttcggttacagtgatgcacttttaaacagtttaggccatcgctaataagcttcaagtctcagcttttctgtttgtaagttaaaaatttggaggtaaaaaattagtgctttcatttatagtacatcacaatatttccaagaaatagcccgacagggagaaactttcctacagtcacgaaccatttgactcctacaactccatctttggaggctgccagcatgttctgagtccagggcagatccgatgaataattttcctgcttctcatcctagaatatctgcctgcctcacaggatcaagtccaagccccaaacctgccattcagggacctcaattctgcatcctacctactgcttcagctgaggctcctgcgtgcggtgcctggaacacgagcagcaggggctgcctccgcacaccggcgcgcgcacacccggtgtctttgctcatgcagtcctggggcctaggacgcctcctcctgctcttccttgccttgctcatatctgctcattcttcaattcttggctggtatcatctcttccaggaagcctcctcctccgggtctgtgtgccctgatagcttgcttcctctatgttattttattaaaaagatcggtttatgtgtatatctctaaactttacaagctaagtttttgtgtgtttgtgttttatttattctttttgagacggagtctcactgtgtcacccaggccgaagtgcaatggtgcaatcttggctcactgcaacctccacctcctgggttcaaccaattcttgtgtctcggcctcccgagtagctgggatcacaggtgcctgccaccacacctagctattttttttttgtatttttactagagacagggtttcaccatgttagtcaggctggtcctgaattcttgaactcaagcgatctgccagcctcggcctcccaaagtgctgggattacaggcgtgagtcaccacgcccggcctacaagctaagttttaattcagcaaatattttttgtccgggctctcttctgggattggagcctagacggtcaaggtccctgatctcaccggcttatgttctaaagagcgacagatggggaacatgtaaatgaacaaattaagcaatgatctgggaaggaagtggtgctatgaaattattattaaactggtgggtgggactcgttgggtaaagggggaagcagacactgagatggaaagggaggagggcagactgggcagaggagaagcccagctcgggcacagcctaagaggcctgagctgacgtccaggagctctggggatggggcagctctcagggtggtcctgaatttcgttagtgggttgggtattatgaccaaccagtagtcatgggacatgagctctccggggaaggggagggagccagaactaattgtcttggcagaggtgatttcccagagggctcaaggccatccacaggcaggccccctgcagagggaatggcagtgcctccccctcgagagatgggatggtgttgacagtgccccccaacaggagggcaggggtctttggcagggtggtaaggggcggtctgactgagaagaggtcagctggggtaagatctgaaggacaggaaggagccagccatgggcagtgacgacacagaagcgtcctggggagaggagcgggactgtgtggttgcaatgtcagtggggacccccggggggaagggcaggactgacatggcctttgagaagtctacacgtctatgtagaggacggatcataaatatgcgagagtggaggcgagagcccttttgggaagctgtgcttggaagaggaggcgggcaagcagggcactggctggggacgtggagtcagaggtgggcagacgctggatcagagcacggggaaggccgtggtgaccggggattgaatgcagggtgaggaagagcatggaatgaaggatgagctttagcttagcggcttgaggaactgggcggtgctgttgactgaggtggggtgcaccctagaggaaaaggttttctaggagcagctagcactctgctttgtgaaatttgagctgtccattgaacaatcagtggagacactaaggaagcagctggctattggagtcggaccgaggggcgagatgagggtggggtgtagatttgggagccatcagtatgtggatagtatttaaggccacaagactgggctgtatgttatgtgtcacaaaggtgaagtgtctcaggtgtccccacaagccgacagtaagtgctgaaccaaacaaccacggaggagagaaacagaaagcaacaggtccaggttcgctgaccacttcctttttttttttttttttttttgagacagagtcttgctctgtcactcaggctggagtgcaatggcatgatctcagctcactgcaaattccgcctcccaggttcaagtaattctcctgcctcaggttcccaagcagttgggactacaggcatgtaccaccatgcccagctaacttttctatttttagtggagacggggtttcgccatgttggccaggctggtctcgaactcctgacctcaggtgatccgcctgccttggcctcccaaagtgctgggattaccggtgtgagccaccactcccagcctcgctgaccacttcttatcttgcaaactgccaccaccagagtctgggctaccgaggaggccactaaggcatggaccccagacctgctgggtaaattctccacctgccgtgcctgtgacgcctgccagaagtgggaacatgggtgggtgtttaaggatcccctttccctccccactgcagacagagacctggctgatttttactaattttctaaggttatacgtcacacatgtttattacagaaaagcataaaaagaaataaagtcctctttggtcctgttatgcctagagctactcactatgacatggtaacatcttgtttccagtctttttcttctgattctattttttcccacacacacatttgtttcaaaacagacatatgtgccacttgctttgaaattctgatttctcactgaggatggatgtaaacctttccgccatgccttcataaccttcatccacacgaatcagagcacgtctcacggagcgtgtttgatgcaccgtctctgttactcctcctgcccatgctgtgaggaagtcccattgaaacccatcttatgaacgagcaaactggtgctcacacagccacagtccatggcagagtcctaactcctgcaacactgcagtgccgggctgtgtgaagctttaccaccgatttatcacaaaataaaccaatctttctcatactgaggcctttagacacttcgatgattttcagtttacgctaatataaataatgctgcagttggcaccttttttcctaaaatgtgtgtgggggtgtgggtgtgtttgcctattatatatttcaggttagtcctttaggatagattttcaaaggtagaattattgggtcaaataatataaagtctttatataggtattgccaaagtggtttccagaaaagttacgctaacttatgatgtcctcaccaaccttgagaattattattaaaaaacaaaacaaacaaaaattaaggccgggcacagtggctcacacccgtaatcccagcttggctttgggaggccaaggcgggtagatcacctgaggtcaggagttcgagaccagcctggccgacatatagtgaaatcccgtctctactaaaaaatataaaaattagctgggtgtgttgcgtacacctgtagtcccagctacttgggaagctgaggcaggagaatctcttgaactcgggaggtggaggttgcagtgaaccgagattacgccattgcaccccagcctgggctacagatcaagactgtctaatctctgtgctttacacccttgtcagcgaaataccaggcctgtttatcccaaaccatcacatatcttctcctgggaagggcccttccgtgttctttccctcccacttcccagtgcacccagtggtggtggagactagagaagctctttccttccatcccatcagtgccttctgctcttttttttttttttttttttttttgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctccgcctcccaaagtgctgggattacaggcgtgagccaccgcgcccggccgccttctgctctttataggtgcatgccaatcccttcattttctaggagcactgctgcatgcaatggagtaataaggacacgctgggtaaattatttattttctctgcaggaagccactgatacagcactaaggacttgtactgagctaagccagcacctgcggctctgggatgtgttcaagcaccgtcttgtttgtattaatgaaaacttcctgaaggacataactgaaaagagagaggcttgagtgcccatcctgggatggccgggcttccctcccgcaagtcagctctgggcaacctgccagccagggcgtagctgatgctcattaaggagaagctgggagaggctgcgcctggcttcgtgtcattgctcatctgtgatggtgccgctgactctgccttgcacacgtacaagtgcatcacattgagaaagggctctcggaccactggttgtgatggctttgccctgagtggcatgtccaggatagacagcaggaagtcccccactggtactgtgagtcatcaggggcaggccacagggatctttaaatatagacgagggtttaattttgaataatgttgcaaagctggggaaggctacagactgacggccggcagacaacagggtcatacggtgcagccatcagcgctggggaaggtcaccagggaggacagaaaaaccacagctgcctcctgactgccacttatcctcaaccactttccatatcttggttctagtttctatatttattccctttccaaccacataaatgctaactgtgtgcctcacatagccatggaactactcactcattaaatatttctgtgtaacaaaaacaataataatagtgataatgggtaacattaatcgaggggttacccaacacaccaggcaccttcagacagcatctcctttaatcctggaatccctgatgggtatgattctcccccaaagagcacacgacatcctcattctctgctcagcacagactcaccatttttttccactggtacatggcagcggggacagggcttggtggttttcttgatggtttctttggaggctgcttcccaacgagcctgctcggcggctctttcatcgactctgtaggcctggggaaacaaagaggaaaggcgtttaatctcagctttctattactgggatcagagtttatgttccctgtacgtcggtacaggaaattcttgaagacaggagtgccttcgggcaagaagcctaaatatcaatgcacttgacaaatgctagacagctactaggcggatggggacactctccctggcatgtggcgtatgcgtaggagcggggaagagattgtttggttttgtagtgtgagctcctctattctgttgttttgcataattgtaataaataacacctatcaggtgcttaaaatgcaggcaaggtgatcaatgctcaaatacacttctcattagacacttcatcagatgtgaagtgaggatctagtttttattccacattgaggattcgatgggtgaaaacatggcccaaagctggtaagtgggagtatcagtgtgactctggaatctttgcttttaaactttgctctacatcttgttatccttccttgcacctggcaaatggggaactccaaatgttgtcacagaagggacaggagcaagaacaggaaatgaagtcgatgtgccagagagggcagtgggagctgtgagtgaagactgtggccctggaaccagctgtctggttcaaatcccagctctacccagacgggtgactctggaaacattccctaagctctctgacagtctttatctctcagatgaaacaccttgtgcattgggggtatggaggattctatgagttaatttcttcaaagactcagaatgactccagtgtggcaagcttttaatacatttgctgacattattcatgtcaccgagagctgggtgctgcctgcaccatcatgtataaggaggttttctggtgggggtggaagcaagaggtcctgggctagctgtgcttgacatctgtgaccttaaggaccagccattcgctgattatccccagataagatgcagcatcaccaaaaacatgaatccaaactttgtcatttcactttcgaattccaagcctttttgaaatgttaaagtttttgagtctttatagatgaagtattatgaggaaaataactgtactgcatttaatagtttctttaggaattagtgttcatgtttctgttatttctgtggaaagtcaattcttccagagccaagatcacatttgagacatcctcatatccccagtttctggcatagaatctggtacacagcaggcgatcagtacatttcaggcaagtgaatgaatgaatgacgcagcccaggaaggcactaaactttcaggggttaccaaatttcaggggttaccaaactttcaggggttaccactaaactttcaggggttaccaaacatccaaaataggaccccgtgaaatgggcagggcacatgggtggtatccctgacagtggtgggggcaccacagacaagctttgcctagggctggtcactgggtgaagccaatttcgtttctgttaatgagccatcatgggcacaaaggaaacacccttgagaactgccagggtgtcacgtgatttgtgaatactttgctagaataacgtggagtcagctgctcggaggcaacggtaggtcaatgagtgcttcctttgctaagatccactcacggcagaggcccagtgagggcgctgtggttagtgagggccatttcacaacttggtaactaggtatgcatcttcatggcacgccttccagtcaccacagagtcttgggtggtcctaaccgtcagtgacacgtggcaaacacccatccccccaccgacctgcaccccaacgccaccccggcctcatgttccacgctgttctttttcaggtctagggctctgtagctctgcagcaatggtttagattgcttgttggtggcaagttggtaagtcatacaaattggagaaaaatacaattttacttatcagaaaataatttcaaaatgccattttttagcaacatggcatactgcatgtgaagggcaatttctcccaggtccacacacctaaaaatgctggatcaaatatggaaaaaaatcttttttaaacgtacggctgatagggtgggaaggcaaaggaaacccttaaagacagcaaatcctcctggttcgggaggaaggaacctggcatttgctgtggggctatcttcttagtcccgcgctgcccatcatctgggtcttcccaggccctaagggcacaggcaggagacaaagcctccagccagagccaggtgggaggtggaatccagttttactacacacagaggacctggactcctgagggtgacgttctcagtggaggaagccagggcaaaagcccgccctgaagagataattgacagatatgtgctggtctcaggctgggttctgtgaggcagcaggtttggaaaacatttttctgaacattcctaaccatcaggcctcggacacgagggttggtgaaaagaattcatcctatctgattagctttaaaaaacctcaagtcaaaaattaatttgaaatattaccagattggcatataccctggaaccaggcggaagcaaaaatatcttttgtggagcacagcactttaaaaagccaaacctcaaggaaattacacaaataaaattctaagaaatctgggatcataataaaaaagttaaaaagtcacctaatacaggagaaaactagctacatgagtgaaagtcacagaattacagaaactacagaatctaaccagcaaaggttgtagatattggaatggccagagacagagtactggccaggcatggtggctcacacctgtaatcccagcactttgggaggctgaggcaggtggatcacttgaggccgggtgttcaagaccagcctggccaacatggtgaaacctcgtctctgctaaaaacacaacgattagccaagcgtggtggtgtgcacctgtagtcccaggtacttgggaggctgaggcaggagaagtacctgaacctggggggcagaggttgcagtgagccgagattttgccactgcattccagtcccggtgatggagtgggactctgtctcaaaaaaacttaactgagtataaactaaatatgtttgttatatttaaataaataaataaaggtgatgataatggaataagagactgtcacaattaaccagggagatgtaaaaaagaaacaaatttctttgttttgtccatttttctggacatgaaacactaataattaaaattagaaactcagttgatgagttacataacaaattagatacaaatgaagagagaatttgtgaactgaaagatggagctgaagaaattacataaaatgccaagaagtaaaaaatatgaaaaggagattaagagatggggggataaggtgagaaggtccagtgtttttctaagtagagttctggaaggagataacaaagagcatgagagagaaacagtgtttggagagagtggcaaaaaaacacacaaattatctacaaagaagttacaattattccccccagctgatttcttaatgcatgggtgctggcagacagtgatggtatcttcaaagcactgacagaaaataccagcccacttagaattctatccaagcaaaattaatttttaagaatgagcataaataaaaacacagtaataaaaaacagcatttcccatcaacagaagttcattaaagaaacatgatttggggccggatgtggtggttcacgcctgtaatccaagcactttgggaggccaaggcaggcggatcatgaggtcaggagattgagaccatcctggctaacatgctgaaaccccatctctactaaaaatacaaaaaattacaaaaaattagctgggcatggtggtgggcgcctgtagtcccagctactcaggaggctgaggcagaagaatggcgtgaacccgggaggctgagcttgcagtgagccgagatcacgccactgcactccagcctgggcagcagagggagactccgtctcaaaaaaaaaaaaaaaaaaagaaaagaaaacaaacaaacaaacatggatgtgggaggccaaggcaggcagatcaccaagtcaggagtttgagaccgtcctgaccaacatggtgaaaccccgtctctactaaaaatacaaaaattagctgggcgcggtggtgggtgcctgtagtcccagctactcaggaggctgaggcaggagaatcatttgaaccgggaggcggaggttgcagtgagccgagatcataccactacactccagcctgggcaacagaacgagactccatctgccaccacccgccccgcaaaaaaaaaaaaaaaaaaaaaaaaaagaaacatggaaataggaaaagtccagaaggagccaggagctgcaagaagaaactgtgagaaaagaaaaagaaaatgggtaacgtatggtaaatcacaggaaatactgattgtctaaaactgtaaacgatgcttaatttgctggttaaaaaaaaaaaatccaagtaggctgtgtgtggtggctcacgcctgtaatcctagcactttgcgaggccaaggcgggtggatcatctgaggtcaggagttcaagatcagcctggccaacacagcgaaaccgtctctactaaaaatacaaaaagtagctgggtgtggtgcccacactactcgaaaggctgaggcaggagaattgcttgaacctgggaggtggaggttgcagtgagccgagatggtgccagtacactccagcctgggcaacggagtgagactttgtctcaaaaaaaaaaaaaaaatcagagtagaactagatgccggacaagaatagcacagaagtgtgagaattggatgattctaatgcgctggcatgattcaggcagagggtccttagatttttttacattaatatatgtttacattctagggtaatcaatacaagagaaagcaatttgcttctaaacaaggaaaaatacagtggaaatggcaaacaaaagagtcaaaagaaaggcaagaagtaaaagtaaaactatagaaatgtagaatgtaatagaaagtataaaataaaatggcagaaatgactgcaaatatcccagcactcccaacccgtgtggacagattatcattgagggcaggtcttgctaaactctagagtcttagcacttatctgggaggccttgtctgcaagaggagcactcaggggctgaagtttctggctcaggtgtgtgcacacctaaagcctttgttacatgttgccaagttaagagcattttcaactgggcgaatacaatgtttattctaacaaaggatgttatactcagcccaagagaaagattcagagctcaacttgaagaaacctcctgcctgtcaatagcacattactggagaggaattacaaactggaaaattgcaaatttatattaatatgctttgttctgtccaggaagaaagattaaagttacagcaaaagaagagaaataattacttttcaaaataccaattttctctgacttccgatcccccgagcacacaaggcagagtgggtataacttgcaggcccaccagaaagccactaggatttccccaaacggctctggatgtaacacctccagcagcaagcgtccttcaaatcaggacactgcaagtttaatacctaggagtgattacaaaagactacccgtgtaaacatttccacactagtgtgcactgagctactggatgggccagttcactcaggggagagggaggtagctaggagggtttgatccttagactggaagagggaaaattgagagcagcaatttctgttttcacctgcaaggatatgtacccttatcatttccttcacagactctgcaactgggccaatgttacttcttccccggatcgatatgttgaaatcctacccaccaaggtgatgctactggaaggtggggcctttgggaggtgattaggtcatgagggtggagctcttatgaagggattcgtgcccttattaaagcaaccccagagagctctcttgcctcttccactgtgagaagatgcagtgagatgccagcagtttgcaggaagagagacctccccagatctagagcctgaggttgaggcttcctgggctgagctttggttcctgtaagccatgggcagcagcgtgggttaagaggcaccctcatgtccacaggacaccagagctgctgaggggccgaggcacacgtgagccaaggagtcaaggaccccctcatggagatgcccacactgaaggtcagagacagagaagaaagcctagggaagagaaaataccccaaaccctaggaaaagaccaaaatgctgatgtcgcaaaatggtttttaatactgttaaagcaaactaagtatggcctaagaaggactccgtacttctgtatttgagtccttgtggtcgaacttagccaagattgaaaacccaacttaggagtgtgtctgacttaatatgtagacaagattgaaagtctaactctagagtatgcaactgtaacaacagctgggtcttggccaatcccagcagccatgcttcagccactcatacactgctgagtgttcaaactgtgttcaaatgaggccgacaccaacttgtaaccagcccgggtgtttctgtacctgacttccgatttctgtccatcacttccctttttgtctataaatttgttctgaccccgaggcacccttggagtctctctgaatctgctgtaattgtgaaggctacccaatttacgaatcgcttttttgttttttttcttgctcaattaaactctgctagatttaatgtgtctgaagttttttggggtttttttgtttccttttttttttttttttttttttttttgagacagagtgtggctctgtcgcccaggctggactgcagtggcgtgatctcggctcactgcaagctccgcctcccgggttcacgccattctcctgcctcagcctcccgagtagctgggactacaggcgcccgccaccacgcccggctaatttttagtagagacggggtttcaccatgttagccgggatggtctcgatctcctgaccttgtgatccacccgcctcggcctcccaaagtgctgggattacaggcgtgagccaccgcgcccggccgtgtctgaagttttaacagtaccaagctaggggagggtgttttagccggcaggacagctacccactttcttttgcagtgggggtggggttcacgctgacctcctgggactgtcaagggcccaggcagatcttggccttgattggagagttaggggttacggtgtagaaaactaataagatgtgtcttttcttttttttttttttctggtagacagtatgtgctcaaaggttatggttttattcctccatagggcatgaagcagttctgttatctaacttagaagtcaaagttcagcattcctttcccaatgaacgacatggcattctgttcctcaaacgctacttgtgctgattttcccattaatctgatgactcagacctcggcacgggctaacacagagctgtgtaggcatggcgctgggacagctgcagggtgttagagggaggggcggccggcgggtccgagaccctgctgcccaggaggggaaggctttgaagaagtaaggacgcttctgttacatgaggaagggcactgtgcggcaggggctctgcccacatcacagaatgtagtaactgcgcatccctgaaggacggagcttgtcattaactatttcagctggagagatcagtctcagaaaactaaataacttcagacccaggccgcctggcctgcgagcagtcggttcagaatcggagccccgagctgcctgggttcatactccaggcccctgcagccttgatttcttcctgtcattatcaagtcacatgctacaaagagggctaagggactaaggctaagatgctgtcatggagatctggaagtccccggggacttttgagagcacagttttcaaacagcttgtggccaggcgcagtggctcacacctgtaatcccagcactctgggaggccagtgcgacggtcaggagttcaagaccagcctgcgaaacatggtgaaaccctgtctctactaaaaatacatataatatttatatatatgtatatatttatatatatttatatatatttgtatatatatttatatatatttgtatatatatttgtatatatatttgtgtatatatatagcaacctcagtcttgatatatatatatatatatatatatatgctgggcctggtggcgcacacatatagtcccagctactcaggaggttgaggcatgagaatcacttgaatccagaaggtggagattgcaccgagccgagctggtgccactgcaatccagactaggcgacagggcaagaatctgtctcaaaacaacaacaacgaaagcaactaccaccaccaccagcacccagcttgtggtaaagacagtgggagaagccacccagcccccctcccctcactgcagtggctcacctgccctccacttgcctgcttcccctggcaccagcactgcaactccactcccagctgcccacccgcccttctgccctgggccatcgctgctgcctggccggttctcccttccccaacctgccgaaagtgctttcaagaaggacaccaggaggccacggctgccaaagctcatgccctttctttgtcattgtctccaactgtcccactgcacctaacatgtgggaaagggtcaccaagaaggcccttggagttcctgcccttctcagcatcacagctcttcctgtgcttcctatcctcacccagcggatccacggggagggaggggagtcccagacccagtgactgctgccactgctgccagccccagggacctggggggcaggagaagcagctctatgacaccccgggagtgggcggtgcccaggccactggtttagacctttgactgccacttccgagaggggatttctaccaggaggagcacatctttgctttgcatccttcatgagtgtcttaatgctgatgtttaaatccttctggagtgatctcaagcagtggctgggtgcccacaggttcaagatcaccaaagcgattctaaaaatgatcccaaggcttgtgtccagactctggagattgggattcagtaggtctgtggcggggtacagaaattagaatccctaaaaatgccctaaggggttgcgaggggcgggaggtttgggaaccattcatcctctggagggcgattctccctttgcgcctgaagaggaacatggtgagctgggtaacttaccctctgttcccgccttagtcatcaagctctaaagcaatgcctgcttattgtgttgccaggaggggaaggttttgttgtgattcagcatcaccgcccgattgtgcaataaagtgtggctctcacggggcagtgtaactgttaggtaattgcatagaattctgtgcctgtctactgctcacccgtggcaggaggaattgcatgcatgcatgtgtgtacgcacgcgtggtggaggtgggggtggaacaggacaagtctctctcctaatatacttcatggctgaaaatagcgatttcataaatatatatatgaaacatctataatatacttatatatagatgtttcatatatatatttcatatgattataggaaatatatttcatatacatatagagagagacagagagaatcaaaattccctcagaaaggtaaaggcatgatcgtccatctgtggctcaagaggaataacctcacaagggtcatcgtgagtaagatcaacacacaaacggcttagcacagagccaggtgcaccctgaatgctaaccgtgtgttttctatgatcaccaccattattactttgttattgtaatcatcacgatcatctctaaagagatgggaatatgaccctgtgggagtttgtacacatggaaaagaccactgaaggcctggattggccttaaatctcctttaaaaacacaagtatgggaggccgaggcaggaggaacacttgagtctaggagttcaaggccagactggtcaatataatgagaccctgtctctataaacacacacacacacacaaaactccactggtaaatcaaaatgtacttatataggttttaaaagctgaattaggctgggcacggtggctcacacctgtaatcccagcactttgggaggccgaggcgggtggatcacgaggtcagatcaaaccatcctggctaacacgatgaaaccccatctctactcaaaatacaaaaaaaaaaaaaaaaaattagccgggcgtggtggcaggcacctgtagtcccacctacttgggaggctgagatgggagaatgacgtgaacctgggaggcagagcttgcagtgagccgagatcgcgccactgcactccagcctgggcgacagagcaagactctgtgtcaaaaaaaaaaaaaaaaaaaagccgaattagcgcctaggagacacattgatatacattgaagctagaataacttaaggaactgcatatgtgttatctttcctgctttaagagaaactcatttgtgacacctgtgtagccaataattagacaagtctattctaatcctaaaaatccatttaagcctgttttccaaaaaagagcagttgtcattaatcatgaaaacagagttggcttaattcagctatgaatgctttcaggtgaatgacagcttttaaatgtcagctttctcatcaacgctcgcctctcttctcacaaacactgaaaccttccacctttgcagacagcagccttcctggctcagtcaagcaggtgggccagttgagcactgctgcgtgtgagcagcccgcctcctgctggtgagtaagaaaatggcatcacttttcaggggccttgagctagtcaacgttactgcttggcaacgggtgtcaccaaaacatgttttgttgttctcacattgtcttatgactatctctttttggagaatatgtatatatgtatatatttaaatgtattttgttatttttttttttgagacgttgtttcgctcctgttgcccaggctggagtgcaatggtgaaatctccgctcactgcaacctccacctcctgggttcaaatgattctgctgcctcggcctctcaagtagctggggttacaggtgcctgctaccacacccggctacttgggaggctgagggaggagacggagtttcaccatgttggccaggctagttttgaactcctgacctcaggtgatctgcccgcctccgtctcccaaagtgcttggattacaggtgtgagccactgcgcccggcctattttgttattttttttaagagaaatcatcagagtgttgggatttaatggggtgtctagccaagggctccggggaatacaaggctacactgtaagcaatacaaggctactccactaagctccaaactccccaagccatgctttagaatgcaattcagaagggcatttgtttttatttatttatctatttttgagacggagttttgctctgtcacctaggctggagtgcaatgacacaatctcggctcactacaacctccacctcctgggttcaagcgattctcatgcctcagcctcctgagtagctgggattacaggcatgcaccaccccacctcgctaatttttgtatttttagtagagatgggatttcatcactttggccaggctgatctcgaattcttgacctcaggtgatctgcctgcctcggcctcccaaagtgctgggattacaggcatgagccaccatgcctggcccagaagggcatttttgacaatgattctaacagtggtgatttctgctaggagtggaatgtgtgccaagtgccacagacgagatcttacagagtcttgccccatggggccctaaatgcttcctaaaggggaagtgaattaaaataatatctatcaacctattttgagattaatgggggaaatggaacaacataaatattaagtagcagaattattaataggtaccatttattggttattttaaaagtgctttgtgttcaactattgttacaagttgacatatgggaaaaatctacacttgagctagaaaatatgctgatttgtatttttgataatgacattctctagtttttggttggcttaggtcagcagtgaccaaaattatccacatagatgggattctgaatgcggaatcatcactaataggatgtgagaggggtcaaagccgaccacagagcctaccttttgtgcaaagtatagttattctggcacaaagtagactattatttttgctagagtgaatgcagaaatattttcattcaagaaacatgtgttgggtgtctaagatgtgccaggcactgtcctggaccctggggatacatcccagtaaacaagagagatgacaaatagcaagccaacaatccctgccttgtggagcttccccattagcagaacggcggctctcagaccagcggcaccggaagcgcttgtgctgtggctcccccactacccctctgggtctgaatccataggtctgggattgcgctcaaggactggcagttcaacaaattcctaggtgatgccgatgtcgctagcctgcagagcttcggagaactactgctcgcagaaggtctacatacactgtggtcaacaaagacagagagaccctattttttttttttttttttttttgagacagggtctcactctgttgcccaggctggagtgctgtggcaagatcatagctcactctagcctggaaatcctgggctctcgagtagctgggactacaggcacatgcttctgtcctctgctgatctttaaaaaatattttttgtagagatggggtctcactttgttgcccaggctggtttcgaattcttagcttcaagtgatcctcccaccctggcctcccaaagtgtggggctgccggtgtgaaccaccacactcggtagggcagaatttttctcttctctgggaaaccgaggtctttgctcgtcaggccttccatggactgggtgaggcccacccacattatagagggtcatctccttgacctcaaagttaactgagtatagatgttaaccacgtctacaaaaataccttcacagcgacaccttgactactgctggttccaacaactgggctgtgtggcccagctacattgacacagaaaattacccatcacagctaggctgaaactcatgtttaagactagatctgtttgacttcaagccccctctgcttgtcttggattcctcagacacgggtgggaacacctagtccttgctgaaagaaggtaaatgcaaccctggagaacagcagtgctgagcctaaatgggctatgcctctgtgcttacaggggtgctgagtttaaacgagctatgcctctgtgtttgcaggggtgctgagtttaaatgtgctatacctctgtgctttgcaggggtgatgagttaaatggccatgcctctgtgcttgcaggggtgatgagttaaatgggctacacctctgtgcttgcggggtgctgagtttaaacgggctatgcctctgtgcttgcaaggaacaagtgtagagcaggtgaaccgttttcctcacacatggtcaacatgcttttctgtggagtgacaatattttgtcccccctgccagccccgtttttaatgaaggaattatgggggccaggatccagctgttagcttttcaaatctgcacacctctcagaaatgctcctcctggggacacagtccttcgattccctcttgcctgttgtcggctgggccactatgcaggcgtggctggggtgcctttcaaagtggcgttcactcccttttcccccaggtcattttatttttgtttctggacaaatccagcattttccttaagggtttagcgccatctggtgcatcagaggcgcactgcagctgcttccctcctgatactgagtggggtgtgcagagaattgccaggggcgctttcctttgaggagctccaaatgcccgtggggtatgcggtgtgtatgtgagtggcgagtgtgtgcagtgttatgtatctgtgtgtggtgtgtgttctgtgtgtatgtgtgttgtgtatatgcgtatgctgtatgtgcagtgtgtgtggtgtgtatgtatgtgtgtgtggtatatgtggtgcgcgtgtgttgtgtgtgtaacgcatggtgtgcatgttatgtatatgtgtgcgccgtgtgtgttgtgtatgtgtggtgtatgtggatgtggtgtgtatgtttatgtgtgtgtggtgcatatgtgtggtgtgtgtgatgggtgtgtggtgcatatgggtggtgtgtgtgatgggtgtgtggtgtgtgtggtgtgtgtgatgtatgtgtggtgtgtgtaatgggtgtgtggtgcatgtgtgtggtgtgtgatgtgtgtgtggtgtgtgtaatgggtgtgtggtgcatgtgtgtggtgtgtgtatgtgtgtatgtgtgtggcatgtgtgatgtatgtgtggtgtgtgtgtatgtgtgatgtgtgttatatatgtgtggtgtgtatgtgtgatgtgtgcgttatgtttatgtgtgtggcatgtgtgacatatgtgtggtgtgtgtgtgtgtgtggtgtgtagctgtgacaataagtttctataaaaatattttccacattgcgaacttgttctagctgcttgtttatggagtctagtacacagggtatacagggtatagacttgcaaagtcggttcagaatttacattcagaccttttttaccaactctgctgggatcctgaaacccctctggaatccaaaagccttcaggacagcatcattttcagaggagggtcccatgtgtcaggccaggcaggcatctggtggaggctgcactgtggccgtgcagaggaagactcaggggacccgcaggctgtgacccctacaggtgagtgagctcaggggacccgcaggccgtgacccccacaggtgagcgagctcaggggacccgcaggccatgcccctcaaggcagaactcctgggggtggagggaaccccccgggggtgctgaggctcctgcagagggaggacgcccctggccggaagctgcaccccagggaagtgcgttgcagagccttggtgctctgccgtgctggagtgacagtccagaagagaagaagggtttctgcagtgcaggagagcgcttggagagccccagccccaggtctgcatggtcaggatcggcctccaggggcaggcgtgtggtgtcactgtgtgtgtacccacgcaagcatgccttcacttgtctttcaatcccagtcaatcttatctttcctttcctctctccacagtgcctgacagttttagcattcagccttaaaaacccaaacccccaagtttcaccattttgtaatactttgcaacttacaaacggcgaaacacacactcatttcattatttatagcttggtagatcttactggctctgtgtggcaggcgacgaaaaggctgtgagcctttgagcaacttgcctggaagaggaggaaatgaaaccgggcctttgacgacctgccaagggccatttctgctgccccagagcaaaccttcgcacacaagctgagtgccttggaaacgcactgcagaggggcgggtgctgtcctggcactgactcagcttttcacagcgcaaggccgagcccgaacgacgcgctggctttaatggagatctgtcgcagccgttccatcccatctgcacatccacttaggcggcgggtccagggtcatggattcaagagaagtggcatcaaacctgctttacttaaaccaacaagcagttcagaaaatacactcccaaataaccggggatctagatctccgggaataataaattacacccatctcccaatactgggactgcatttgtgtgtgaaggcagtcaatggctgagagacggctctgcggtgagatgctggggcaaaatagatcaaaaaagatctcagctccctggagccactgctgcttcagtgtcctccactgagggaggtgcacctcctagcctctcctggactgtaactctgaaggggtgggtgtgggtgtggggagcatggataaggggcagttcgttggagattgtcagtcttgcatcttgatcgctggctccagcctggattctcctctgaggtggtctaggcatccactcctttccccactgaacccctagctgagatgtccacaatgaatgtgtgtctccccgaacaacctgcttttgtttctgtctcctcttccagccaatggcaccaccatcgttctaagctagacattcatgcatcaacattaacccgtctcctctcatcctgtcttctaatccactgccaagttctgcagatccgacctcaagcccatcccctcctctgtattccctggccggattcctggtgcctggtgtgtctctggtttggcccttttagggggtgctctgctctgctcccagtcccaccaccttgggactgaggtcacaccgtcacatcacggcgatagggcagctcacgcccagtggtggagggtggatgcgaagggctcacctctagcctcctacctctggctcccctcagtcttctgtggcaaccgcactgcagtgggactccacctctgcccaaccctgcttccttctcttcctgaaggtgctgttgagagcaccccaagacactccctgcctgcaagtctcagagcctgttctcctgggaacctataacctgtggcacttggtgcctggatagtcctaggaagcaaactctaaaatggagttagagctggaatccctcccgccagtggccaaagaggagcctgtcactgttggaagaaagtgctggaagctctgagtggggccccgaggagcaaagggcagggtcaggcggcatgcaagcgccctgtctctgcggctgtgcacgcaggcagaccctgtggattccaggtgtctgtggagggaaaagaggtcacgtggggctacctgcgggccaataagagcatcccagcaaagattttgggggttcagcagctgagaacgatggaccatttgaaagagagcccctggcacgctaccgagccctgtggagttggagcatctgtgcagcaattgtcataagacagaagtggggcatctaggcccaggcccaagcaggcccacggggcgtgagcgagctgcacaagcaggtcctcagacccccgtgccatccacaccgtggcatgactgcctctccttgggctcacaaccatggccccacggtggtagtggccgggctggggagattccttatgacacactgagggatccaagcttggttcacaattgagttagcttaacatacggctgcaagccaaaaatgcactgtcgctatcctgtaatcctctttagggttgaaagagtggtgaggggagaccctgtcaataagcagagccttgggcaacgcaactgctatggtccgagtgtttgtgtctccccagattcctatgtcgaaacctaatcaccaaggcggtgggattaggaggtgaggcctttgcaaggtgattgggtcataagtcagagccctcgggaatgggattagtgcccttataaagagagggcattaaccagtcacctctcatcctgtgaggccccagagagctgtcttgccccttctaccatgtgagggtatagctagaagacgtcatctacaaaccaaaaagtggtccctcatgagaccccaaatctgctagtgcattcatctttgacttctgagcctccagaactggaaggaataaatgtgtgttgtttataagccagccagtctacggtattgagtgacagcagcccaaacagatgaggcagcagctgacagtggactgtgtgtggaaaggaaagagtcctgagttaggaagagatacaagctcctaagcagtggcaaacgtcttggcagcctctttaagggcagggacagagaaaatctggaagactgaggacaggtaagacaaggagctctgcagagcaggcacgtggacagacccatgggaggggcaggacatgtccgcatgtttgcacagcatggcagagctcacaggagagcacttcaacaagcagatggagggatccggccagtggaccactgccagcctccgccactggccacagcagtcctgggccagggcactcccgtgtggaggaagcgtggtggtgaggtgaagccctgccaggccccccagctcgggcatccccccatctgccacaccgccaacattcaacctgccggcaacaaagagcggcacggagtcctgtgtgtcctccactcctcgaggagaccaactaactggccagtgggtgtcaggtggatcacagtgacaccagggaagatgaagacactccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaacactggtcctgtcacacatcctactgcccagaagctgttgacctgatgagacggatggaccaggcttgcacgatgccgctggagctgcactgtgatgtgggcgctatcctctaaggtgagatttacactctgaatcaacaactaccatggtgcagggtgtgtctccagcaggtagaacgcaatggttcaggaatcaaggggtggaagtagggacggccccacttctcactcccagtggtccacttggagtttatgctctccatctgtgcaacctggccttgcatatataggggccctggcttccagcaagagagtacttttgccagagaacacagcaagagttctggtcactttatgttgcattgccaagggattagcaggctagaaagggagttgccatcctggaaggggtaactgactctcaggagcaggcagggctgcagttatagaatggggtatttaaatgggaagaatgcatttggcacccaggtggttcactgtggcatctcttggtcctcccctgcccaatgttgatagcaaatcattcagtagtcatggctttagaatggcacccaggagcctggacccatcagggatgatgtctgtgtcaccccaccaggtaagccacctagaggtcttctctaagggcgaggggaatctagaatgagtaggagagaaggaagtcaatgggagtcagctgcaacttcaagaccagctgtggcagcatgagctacatatagtttaccctgctaaccttccatttgtacatttctccagtctctctcattccacaagcaaatgtctccaggcagtgcaaggggcagacgacagcagatgctgtgaggctggccagacccctcctccaggactgatatccctgctgctgggtatgtccgcagcagacagctctctgccaagtctctacccgggaagtgcccccagctgaagaaagctgcttcacccaaagcctttcttccttctgcgggaagcccacatcgaaaacctggtctatgcatagggatgtaaggcctgaccactctgtgtccatgcacaacaactcagaaggctcatccagctccagagctccttctaggacctgctgtggcaactgcacggcagttcagccttccttcaaactgcttcatgcgattccccacagcatcctccagtacacagtctgcactcgaatctcaagcagctcagggttttcttcctggaaaacatgtactattacaattccctactaagtgtttttcatattacagccagagatctttcgaaagcacccatctgatgacgtcaatctttaaaaaatctccagatgccttctcactgccctaaatcccaagctcctgcctgtggctgataaggcccttcatttcctggctccgtctccagcctagtctgtggccacagccaccatcactttatggcacagtcaagggagtgtcttccacctccctgaacgtgtcattcatgctcatctccagaactttacacaccctgtccctttgcttaggacacccataagttccttccctgcctgaagagctcatccctgtaggtctcaaatttcacttctttcaatgaacaattcctccaaccccgtggagaactggccaggtcccacttttatgcttccaaagcatcctgaacactctctcgtgcctcttagcatacaacattttaattatttgtcaaactgtttttctacttcactagattacaaaccctatgagaacagtggccaagtccaaagtccaagtctatcttttttttttttttttttttttggagacagagtcttgcactgttgcctgggctggagtgcagtggcaacctccacctcccagctttaagcgattttcctgcctcagcctcccaccaagtctatctttaatgttgtatccaaaatgcctagtactatgcgtggtaataaaaggtgctttataaatgtgtactgagcatccttcttcttccttctttccactaattataagaaattcacagttgaaatgaggttcaaaggcacataatgtaggaagtgtaacacaacgttgcagccaaaattccacttatagatgtgtttaagatttaaaaaaatgttaattctcaacatttaaaaataaagatatttaacaaaaacgcatggattttatgctactgacatcacaaaatcacactggaaggcctggtaccattgggctcacatttctgctgggtaaacatggacctgaactggggagctgtgtagcaggtgtctccccaacaccccacaacaagccatgcccactccagtttgccacagaccacccccacccgccccagcatggggctatgtgtcattatgcttgcaggcttttgtgttgatgtgtttttgttgttctgtttgttttaataggaaaagcagaagaaaatgaaatttatctttgcatccttatcaaaatattgacaggtccatgaagcaggcttcaactctgcctcactcatttaagggttgtgttgctgttggcatttgagttggccatccctggtattgtgtttgacaagccaacaacagcccactcatccccctctttcaaaaggcagagtgaccagtaagaacaatggaagcgcatttctgcttcactgggactggagtggtcatcagtgctggctggtgcagctcccaaagacctgggtaaaataatggtctggggcttgtcaactctatgcccctgggtggccactctccctccctctcccttgcctatggacaaaatctatcacaaaaacttgagataagcctcagaataagatggtgtacgtgaaagtgctttgtaatcaagcacgatacaagtgcatatcccaagcaaattattatatttatcccaagcaaatggtgggtttatttttctaatttaggaggcagatggaaggaactgaggtttactgtggaaatctaattttcttttatgattcaaaagattactgagacataatccagccctgaagctactgtctattcttttcctgtacttacccagcttcatggtagggagggaggtgtgtggatgaaggagggatttgtcattcattcaacaaacacttaatgagcacctactctgtgccaggcactgcaggatacaggatgcgacaggcacaaaccctccactaacaaagcccagactttttaggccgggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctgggtgaaagagcgagactccatctcaaaaaaaaaaaaaaaaaaaaaatcaaaacaaaaacaaacaaacaaacaaacaaaacaaagcccagactttttgtgaagatacagagaaacgatatttcaagtgacgaatgtatcagaatgtacagttgtctgaaagcttacaggatgtagtggggagggcagatggcttctgggaggaggtaacatgatctgggcctagaatgttgagcaggaggcatggttggtaggcaggcatgggcacattcccctcagacactgtagatctattagagagagcagttgctgatccccaactacttaggtaaagtatagccactgaaattgatctcttctgcggctttagagagcaccactaaaaatctggaagtctcagtctgcactcctgctgaatagggagaggaacatcaactacctagaaccagtttatgtggcttttgcaagagcaagtgtgtagttattagcaagcctccaggggcaatacgcggaaggaactggaacacggggaggagaacaagcagggaaaaacaaggaaagcaaacgggactggactctcgttagtctgtgatggattgatcttctgtcactgctttcccaaactcccagcagtttcaacgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaatgctaaagggaagaacagcagaaacgagtcacaaatggctcaaagcaaagaaccctgcaactgaatggaattgaaagaaagtgtgaagagggctgatgagggtatttagttattattagcaaaattcagatgtgagaacacatctaaagccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagccagctctatgaaaataaaagcccttcattctgttatcaaatcgaattgggtcatgaaatttgaagaaatagcttgtttggttcgtgccttcccacatccaaaagcagctatggttgaaataaggaaacttgggaagattggtaaattcgctcatagagaaggtgctggtaattctgtattctttcccctctctgctttgcatctggaaggctggctcccatgggctgtgcccctaggatcccttgtgtctggcttcggtggggtatggcccatgggagacattagcaagagatcggatggcaggaggcaggaggcaagatgtccatgctcactcccttcctgtgtggggctacttccaggcaacgctggatgctccgtgatgacacctcctgtcatgaggccccttctccatggctgcagctcatggggttcatgggactcttcctccccctgcctttacaggcctggggtggtcatggctccccagtgatgctcgctctgaggccctcagccctgtgatggttcctgtgtccccagcccgcctctgcaggtcatccctttcattaacatctcctcctgtgcccatctgggttggcttctctctcccgagggaccctgaccgaatcagagacgtaggaaaacatggcagcaaagaccccaattagttgctttccgttgtctggcaactgttcaccagcagacatctttttagtttggctggttggtttgctttgttttcaaataagaggaattggaggctggccctgtgatcaggaaccagaagcaggaagagcctcatctcctgggggggtctaactgcagggctgcttcatcctgagttctttctgggatgaccctgatgtggattaactatacctcctcagaattcctatcatgtcagttgcttgtgcaacctctgtggcatctattgaagccgtagaaactccatgggagcagggacgttgtcttactctttgtcccgagggcctagaaccatgcctaacatattacgggtgtttaatgcatatttgttgaatgaatgaaataatgtctcatggggcgcagtggctcacgcctgtcatctcagtactttgggaggcttgcttgagctcaggagttcaagaccccagcctgggcaacatgctgaaaccctgtctctacaaaaaatacaaaaagtagcctggtgtggtggcatgtgcctgcagttccagttacttgggaggctgaggtggcagggttgcctgagccaaggataaggagtctgcagtgagccaagatcataccactgcaccccagcctgggcaacacagtgagaccctggttcaaaaaaaatgaaataatgtctctttctttatagatgctgccatcactcaacaaaccatctattaaatgtctgtgcagcagatgtcatcttgggcctggagacacaggggaacagaggacacagtctggttgaagaggttctggcttctgcaactttgcccatgtggcaccctctgctggaatgtcctttaccacaccatcctgctgtcctgaccaactctgacccatcttctgtgacttttccagggaaacctggaagtgttttatataaagctatagagttgctaagctttggtttagcatattactgtaattacgatattcattttccagtaaatctccccccatggctcccctatgagcctctaaagggaaatacacttttcttttctttttttgagggggtggggatggagtctcactctgtcaccaggctggagtgcagtggtgcgatctcagctcactgcaacctccacctcccgggttcaagcgattctcctgcctcagcctcctgaatagctgggattacaggtgcacgccaccacacccagctaatttttgtatttttagtagagacggggtttcaccatgttggccaggctgatctcaatctcttgacctcatgatccgcccacctcggcctcccaaagtgctgggattacaggcataagccacctcgcccggccgggaaatatacttttcaatgcatttttctagagagtctagcagctgcttgacccacccaaatgctcaacttaatgtctgctaattgacactatttgcagacacagttcccccgatgctggacatctatggtttaggtcatctctaactttctttttcctatttttctgaatccaatattaaggttttaacaatttaaaaacatttaatttgggctaccttaatctttaacaccaaggctggatggttcctcttgactgaagaatgaatgggattagagggagggtcaggcgcctggatggctttaggttaagcaatgctcttctttcccttacagctactgtttccaaataaatactgtagatgccagagtatcactttgtggaagcctctgccatgtttgcagtctcagagcatatggatgtaaattgctagactaactccgtttcccagagcctcaggtatacccgcctccattacagcggtcctgaggcaggggtctctgggccattattgcttttgctgtcagtacctggtaagctcgcgtttgaatgtccctgagctaaaataaaattaacagaaagagcatttgctgcctgggctatggaaatggcaactcagtcctaaatccactcatatgctcatggctggcaatttaggagcagacgagaagacccaaattcaccagttctatttatttagttatgctaatattggataaactcatctgcagaattccatatagggatacacttattcatgctctgattttagagcattcagatctttaacattctctattgtaaaatcaaaatattctgggatttctatgtctgtttactaggttcctatcagtacaatgactaaaggatttatttgcaaagatttggtgtttaaacccttgttaacatctacattgggagaaaaataatgagcaaattcatctactgtgatgacgtttttactctttttccctgaaggtttggttgatcctaattaataaataaaataaaatgcatttgcactttcctaagactgagatagcaccttagagagtgaggctcggccaacacattctttacttaatgaggactgaaacaccagttagcatagggcatgatgctgctaaaggacaatgatatccttacataatgtcatctttctgtacatgccactcacagaggtattttcaccagagattctaaactagggcattaaaaacattgaagtagacttagtatggatttctctgatttagacactgttaagttgttttatttcccctctaaggactcctttgaaaatgctcacatgccttgtccctgttccatatctgcccagggaaaagctattttggacatgccccaagtggccactgggaagtctacactgtgccccaaggaggggagtcattctgggagaagccacggccccattcccatggctgtcagctaccagtctgcttcttgcttttttagaatggaactctccatgacctccaggaaacggctccagtcccccactgtatccggagccctgcttggaggaatgagtagggcattctgtacctgagtagttgttcctgaggcttcaaatacggcactgcactccccttcatggtacgcttctttacattcccggcagaaggcaaactgcaaaagaacacacatccattaattagggacattaggttgcatttggcaataacacatttttccttttccaaattcattatattcattcctctggcttgtgcaacagtttctgtataaaaatactttttttgcaaagagaaatcaagttatgttttgatgggattgttcactctttactcaagagtgttccaagcaccatagcagggctacagagatgatgggtcacatttccttccctcaagatgtttccagtctagtggaagacacagtgatatggtttggctgtgtccccacccaaatctcatcttgaattgtagttcccataatccccatgtgtcatgggaaagacctggtgggaggtaattgaatcatggggatgatttctcccatgctattcttgtgatagtgagtgagttctcacgagatctgacggttttacaatgggcttcccccttcgctcagctctcattcttctccttcctgccaccatgtgaagaaggatgtgtttgcttccccttccaccatgattgtgaatttcctgaggcctactcagccctgcacaaatgtgaatcaattgaacctctttcctttataaattatccagtctcgggtatgtccttatagcagtgtgagaacagactaatacacacagtaatgcaaataaatacccacagcaaagtttaattggtattagaatgtaaggaaaaaacttcattcaagacattccctttaatatttgtttacattcaatatttgtttgcattcacagaagatttatatgcccatgtcagtggacttactttcgtattaaaagcctattatggaaaaagaaatgggtggctatgggctgaaccgtgcccccacataatggataggtggaagcaggacctcagaaagtaactgtatttggagacagggcctttaaagtggtaaagggaagatgaggttgttaggggaggccttcttcaatctgactggtgtccttacaagatgaggagattaggacagagacacacggactgagagatgatgagcagcattcaccatgggactgaagacgcccaaggaaccaatgccctctacccgccatcgtacaaagaagaaagctggaagagtgaatgccagagaggctcgtttagggctgtctgtctgggatccatggacctctcctgaaagcacgtcccattctcatcgccaccagccatgctctgaagttactgtcacggttgagttgtggatcagcagtggaacacaccagactggagtcatcatcccatcccctgccacctgaaacaccttgggaaagccaccttggtttctgtgccttggtttccaccttggaaatgctaggataacagcgatagctttctcatatgacccctgggagaggtagtgagatagcacatgctgagtggctacaatcacagcatacaatgtgttctaaactttaaggagataagaacaacagggactattttgcccctactccatttcataggaaggagtttcctcaccagaaaactggtttctttcaatggaactttctttaataagttgtaggcaacatctcccacagcagaaactgtattcagagaaggcatttcagcagaggagagagtgccatccacaagtatggtgtgtggatgatggtggtggtcttagagcatagaggcaaactgacagtatcctctttcccttgagaggtgggctttatgtctcttctgctgacagccagatgtgttgagtacttgactcctagaatatggtagaaatgatggtgtaccactttctaggcccaggcctcaagaaaccagaagcttccatttcctgttgggacacttgctcttgaagcccagctgccatatggtaaggaagctcaacagcccatgggagccccacatggagaagagctgcggcctcagccgcaacaatagccctgtctgagcttttagtagacagccagcaccaacttgccagctatgtgactgggtcatattccaagtagactgttgttatttgaaatcattaaagtttagggtggtttttacacagcaataaataactgatacagtaataaataagaatataatatgctgaaagtagtgtctggaagattcaaaaatttacagagacttacaagttctcaaactaatattttatagtataagttaggaatttagcctaattttgcttaagacaggactgatttgaattgaaaaacaaaaataatagaaaccaggatataaaaccaactctatcccaaaatataccataattcctccttgcctcaaaaaagaatggcttttactcaacactatttttccttcatgttgtcttcaccatgtgaacagagttttctcctttcctacgtccaatttcttgttttaaaagttcatctgaaaagtattttaatctcaggacatcagaaacaaaaaggaaaagcattttataaggaaacaatctcttcagagatatgccacaattgatcttcaagccatcacttttagcatattatattcttatttcttctcacagcagagagactgaactcaaatttagtgaaatgtaaactttatttaaaggttggtgggacagcgtgtgtgcatcagaacgtccttacacaaatcaccaacattacctggtttcagcttctgacatcttattttctctgaactaaaagcgaattcactgaatagtgagttgagttctaggattttctcctatttttaaaaacatttatctgttaatacttgggtctgcctcacactcattcctctgctcttacatgctttgttggaaaaatgtggacgggaggcccaatcatggagaactggcaatggggtctcagcccactgctttctagagaagcaaatcttatctgttggtgtgaaagggaaaaccgttcacatcttattagctcgtggatgagatataaaatcagtttcatggtagaggaacaccctggaggctgatcagtttgtcagaataaataggcttttcctgacacaaagacattaaattccctttcacaccagtactacaaagaatggactattgagaaataagagaaagggaagagcatatcaaatgaaagcctccccactttagcatggcaaaaggcaagcaaatgctgcaggaatattccggtgatgacttcacagggaggcactggctaatttgcttctattcaaagtataatttaaatttagatctatcatgcagtggtccttcccaattaagtaacatgaatctgtctcatgtgcaatgtagaaggtctgatttgatcttgaaaatgtttgggttttcaattacattatccaggactcaagactctcaaccttcagttctcacactacgcaccagagtgccctgcggtactgtaacaaactcacaggggtgcctgggatattctagaattttaagtaaaacacagcatggctattgaacactatgtgatttattaactcaaggtagttcccagtgttaatgtagattgtgctattttccttttggtgacattgtatctttgcaaaggtgggcttttggaagttaccagaatagaaaacaaataccatgtaaacatccatttggaacaaagatgtgatttatttatttatttatttattgagacagagtcttgctctgttgcccaggctggagtgcagtggcaccatctcggctcactgcaacctccgcctcccgggttcaagcaattctcccgtctcagcctcctgagtagctgggactacaggcgcctgccaccacgcccggctaatttttgtatttttagtaaagacgggatttcaccatgttggtcaggctggtcttgaactcctgacctcaggtgatccacccgcctcggcctcccaaagtgctgggattacaggcatgagccaccgtgcctggccaagacgtgattatttttaagaataaaataaagctaatttttccttccatttgtgtgaattatcatttcagataactattaagtcgttatgacattaattcttactatgctacgtggtacaaaacctttcataaccacaactgttaggcatttcttttggcctagaaataccgtgaaaaatgtactgaaccgctaagggcatggggaacagaattctggggaactctgggttaggcagatacaaaactccttcttaagacagtgttcgggccagtttgcaaacacttcccatggcatagctgtttctagagaaaaagcttgccggggaagaaagcagacctagctccaacattttcacatccattctgctgagctgcatgtctcatatctggggcgcctggatccttctttaaccaaccatgtagaaggctgaaatttacccagggatttgctattacttaaaaatggtcttacatttgctgaggctcccttaagctgcataatacctctccaaaccttatgagtcaacattaaccgaatggaagttagtataccaggaaacatggagtcctgtttataccgtatacattttcaggattgtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctataatcagtttattttaagtaagagagattatcctagataacctgaagggggctgattcaatctgtggaaaggcctaagagcataactgagccttccctgaggaagaagagatttcacctgtggacagcagcgtcaggctgtgctcaagagttccagcctgcccttcctgatggccactctgtggatttaggaggtgcctacccagccctgaaaccgtgtaagccacttccttccagtaaatctctccatatatctgtgtatacacagatatatagatacaatgtgtgcctgcatgtatatatatgtagggatatacacatatatatgcatatatgtgtgtatgtgtatgtatatttgatataagcatcctgctggtctggtctctctggtgaagctctggctgataaagctcctatagaaacaaattatttttaatagagacggggtttcaccgtcttggccaagctggtctcgaaccctgacctcgtgatccgcctgcctcggcctcccaaagtgctgggattacaggtgtgaaccaccaatacaaaaattagctggcatggtggcaggcacctgtaatcccagctacttgggaggctgaggcaggagaaccgtttgaaccctggaggcggaggttgcagtgagccaagattgtgccattgcactccagcctgggtgacagggtgagactctgtctccaaaaaaaaagaaaaagaaaaaatttaacaaggtcactttattcccaatcttttgcaaaagaactgatgtaatgaaaactatttaaactttccctgttatttgcaaaattatagttcaaacctctctctctctctctctctctctctcgctatatatatatacatatataaattccaggtagccatatggcaaattcctctcagaattcaacaccaggagaaagttcaccacttccaacagtgtggtggtttcctttcatttgacaataaacatggtcacctaatacattctccttggtatgttttcaagcttgagagcttggtgccacacttttaacttaattctagtcatcagcttatcctaaatgcctaaaaggaggtatagaataaaaaaaaaaagatttaatagaggctaaattcaataagccaatttttttctattgcataatagctaaactattcttaacattgaagtcatatttttgtcttgcaactaatatgtgttgagtatttacttttaggatgagtaaaatcttggccctaggcaacatataaaagaatagcacattttaatctgtgaaatcgtgtactagatctttacatgtttaaataccagatgtagattagtgtttagaagtgaaccctttgaggtagagagacccggagtctgaggcctcttggatcatttattatctgtgtgatcccaacatctctttgcttgagcttttttgcatctacaaagaagaaataataagataaagaatatttaacacagtttctggtacacagtaaacacaacaacacaacaaatagttttctccatggggctatgatgtttaacaagtggtaagagtctgtagaaaaataagagggtagtaagcgccttgttaattaaagcagttcccagtatactgataataatgactgttatgtgaatctcgggtaaaactgacacctccccagaaatgccacacttgtaaactactcataagacataagactgctgtctagaaagggatgaggcctctctttgctggtatacatgctgaggtaagtcactgtcagcccccttagacgctctgtactaccagagagctatgtgaatggcccatcatgcctctcattcaatatcatgtcagtgcagtagtcatttgattgatgtttgagtttgctttcccatatttccataatgaacacattcaaaaggggctgtatgtgtactttctctgtggaagcatgaaaaggaagcaaatgaacagcttctaatgcaatcggaatattccagtggctgctgatcaatcaggttgagagccagtaggtacctacaagcaatgacccttaaaataaggcttgatgatgatctctctatggaagccaagatttctttgtgcctgttttctatcatggctgcatctattataaaagcattctattatgtgcatttatttttcttccacggctctgaaattctgtgttaaaagaataggagagaatcaaataccatcttaggaccccttactagagtcaaggcaaacatcaaaggcatgaagcacacatttgtacttctttgggaatagatgaaatatttttctttttggtgtgtagctttccagaagatggcagcagagatacgtaagtccagcctctgtaaagggaatctatcaagagaggaagtctccctatgagtcaccagccgctgatatatgcaaaactcgttctgacaagacagtgccacagaacggagatggtgttagattataatgcattaaaacacaattttgaaaagaagaaagtaaggttatttcctttcaagtacacaacatcttaaaatcacagactctcatggtgtgaggcaatcttaaactgtgctaagctccaaatgcaaacagacgaagacagtgttctatgtgtggtctccaaagggctaaaaagaaagaattttcaggaggctggatacagctctgtagagtacccacgttcctttgtctttcacaaattctgtactaatccccagggatattaaacaatgccaattagtttcccacaaaatattgtgacctccaacaccctgcagccctaggcttatttttgttttaggtttgctctttgaacaggtccttactttctttggtttaatttccattcttgcaagctctgaaaagatccccgaaaatccccttttcttacaccaacatctatcatcatgcgcgtgcacgtaaccatcccatctttcagttgtgcagtctgcactgacccactcactatgagtaccgtctagtaggaaactttagtaccacctgtctcagaactagggcccctcagagaagatgagttcatgcaatgaggagaaaagacccactgagcttactttcaacaggctgacctcagcacctcacattaaaagatccatgataaggtggtcctcctgacaatggttctgctgggaattaactatccagtctataattacggacaaagacatttacatttacttcctactccaaaatagttttgatttttaccataacttaaagggaaaataaacttaaaaatgtgtattggccatttatttttttcttttctttaagagcgttactgaaatatcatttgcagagtcatggatttttaaaaagtaggtattctttgaatgcaaaatatgtgcaggtagcacagattcaaaaggtacattgtgaaaaatgtctcctttcctccttggtcagctacatagcttcccagagacaatcactgtcacctgtttgtataggtattgttccagaaatatgttctgcactcaatcatcaatttatgctatttttaaacaaaaataccctataaaacattgtataatgtgctgtactctgcttgttggtttttcgtttaatgcatgctacagatggctgtctattagcacacggagagctgctccattcttcctgaacagccacacaatattccagtggatagatgtgccttcgttcatttcaccagcccctccgatcagcatttaggtccttccaatattttgccatgacaaacaaagctgcagggaatgtcccgctcttcaggtcatttcacacatgtgaaaggaaatctgtagcagaaatttctagacatgaaatagctgggtccaagggcatatggactttccattttgattgctttcgcgagccttgtcagtcacaggcttagcagcaaggtgggtggaagctgcttccccaacacgctgtggtctcaaccaccgcctttgtcaagctgctttaaaagaatatcaaatacatcccagcacttttgctaagaccttctttatacatgttttgtcaccacagagttgtgttcctagccaaagcaattactctgaccacgtttaagtcttgtctacacagccaaagctgggtcaggagtggcctgtggtcaggctcactctgactttcctcagctcaacacacatggagctggtcgtctcattctgatgggcctgaatctggcccgcctgccaggaaaggacttgtaatgaatttaagctcagcggctttaaacacagacagccaacaaattagaggtccaggttagagagaaagaaacagtgaatgggggaacggcagcttccctcacttgtggctgtgtcgtgagcctcagctttgcagacttggctctcagtgacgcttgccaggtgacctgactgcagcagtctgccagaggacaggggaagctggggtgggagtgctgtatgctctcggtccctaatcccccgcctcttttcttactttctctttactgtaaccatttctgaaaacaattcctatggggacagtccttatcttccaaggtccccagctctggcatttgtgtcatggcttaccttgttcccaaaggctaaggtaggacctggttgcaagctggaactcttgttcaatgatatgttcacaccatcctgttcatctaaacaaacttcttggcgggcaaatttcaatatctaactgagaattccctttaccatcctgcaaggcctgcccaattttgctttaaaatgagcatttctcagaccttatggagcagttggctccttctagaactggagcactggtcacagagtatcaaattcaatgccactttcaaacatcgccattcattagtgggcccattcaaatattgccattaattagtgaacatgtttgaatatggccattcattagtaaaacgcacagcatatgtcttctataatttttaactggtccctaatcctcgtgaccttatcatttacaatctgcagcaaggcactagactctgtagaaatgattacgctacgccagtaaaaatgtgaaatccaagccatatggcaatttgagcccaatttgtcccatgtgcctgtgggtatccttatgctctctagcacagcaggggaggcgaaatgctttccctgaatacctgggcccgccctgggcaacttggggcaaggccagctttggaaagaggcctgaacatgtttggggacaccctgccagcacatcttacagacttttgtctttggaggttttgcagctcctcaatgatcaatcaatcaatcagtcaaaatgatacattaaccctttattgtatgttgagcagtctcataggtgccctgcaggtatacctgttctggcccctttcccctgcagcctcagccaaaatgatcaaggtgttttcttcccaagccctgtttcttactcatacctctattaaactgtttcaccctctatatgaaactgtctccacctatctcctcttctaaagggataggatttgtatcttattcatctttgtcttcccaagatccaggtgctagaacatagtaggtgatcagtgtctctttgtggcaatccaggtgctggagtcaagtagcttacagctaaggtggatgtttataaagcataaaagagctgaaggacaattgtgtactccatgatacaatgcacaatcatgggttgaattgagtattcttgtgtaagtcttaagggtcccatagaagagatccaggcgggttgaggtcagtgggtaagagcacgtggagatagcatttgtttttctgcccttcacatttgccccttcagggagcattctaacatcaagcttaattgactgcctctcttctaacaacttctcaaaatctattccacccttcccaactcctcttttaagatgcactttgcctattgcatatttccatttggataggttgcagtcacctcaaattcaagtcacttctaattccacgtgattatcatgaagttgcaaggacctaacagaataatggcaatcatcaaacctttgcagaataaacaagcagtagtagctggaaaagcctcaacttctgagaagcagaagaggatagcacagtgctgaggaaacccagtactgagaatggagaggtcaatcctgagtacaagaggaataactaagactttctgccagggaaagtactttagtgacctcggaggccataattttggtccaatggttcaatggtcagctagattcagaggctaagatcacaggcatgatggggtggaaaaggcttcacaacagagagctctgaatcagtttgaaaacagcaaaagatgatgaaaagagagagaatgaagacgctagccagagagggggcaggatgggagtgaagtcccagagaaagtcgaggctagggagacacactcaaaggtttatggctttcaatggaggaggataaggttttgcagcaaaatcctaggagagtcacattgatgagagagttttctcaaggagatgacacccatgcccttggtcttcctaacagagcaccatagcagctctgaatcttctggagtctagggggagaggagagtcacagatagagaggaggctgaaacagttactgtcagttggagcatccatgagacatgaattgaagggacgcccatccatgttgataactaaattcacatcacagcactggctctagttagttccctagaatgtggttcccagactagcaccatcagcatcacccaggagcatgtcagaaaacccgaatttcaggccccacccaagaagtactagaccagaatctttcattttaccaggatccccgagtgacttgtatgcaccatttagagaccctgttctagctcattcattcaaccaaaagttcctactcaggaactccactcagaatgtatgctgtgcattgctggagcctgcaaagatgcagaacgtatgtaatttccagtttcagaggagtcacaattcacctctcccttgctctacccaatgctccctccattccacaagtactcatcaagcatgtactgtgtgtgaatggtaaggcactggccattcttcatggcctcacagagttcacagtcagctgtgtcctgatcatatgatggatgtgaggttccatgggagcacagtgttgaacctgggaggtgcaggttgtagtgaggagatgaggaggttacagacaggagacagggaaatattgggtagaagagggcagttccccagcaaaggcctgaccctcaagcctggaaacccatggccctaaatgggaacaggcattcctgttttcacacccaaatgttgccttttggcctgtcatgcccccctatcctgtccctatataaactccaaaccccaggctccatgagcagaagagcagcagaggagagaagagaaggaatatctgaatgtcgagaggagttctgctgcagacagttagagaggagattggctgctggacggcccaactccaggggaagatcatctttctactccatcccctttccagctccccatccatccatcccactgagagccacatccaccactcaataaaaccctgcagtcaccatccttcaagtccatgggtgacctgatttttctggatgccagacaagaacttggaatatggaaagctgtcacactggccctctgcccttgcaaaaaggcagagggtccactgagctgtttaacacttaagctgtctgcagacagcaaaattaaaagagcgcactgtaacacacagctaactgggctttgggagtcacaggcacccatccctagacactactgtggggccagagcccagaagtgctcgtcctggctcctgcacctgctcatctgcatgctccccctcccataaggagtttgagcagtggtggtggctgaactgatgagccatatgcctgttgcatgtcctgcaaccggggtgggtcagggaactctcccgtttcagcagtaagaagaggaaggtgaactgggaccaatggagtttgctggaaatgatagcccccagaaagtaccaatcccagtgctagggatgatgccagcattctagtgtaattcactctgctagtgtaattctgcaacacttttgtctttttgattttgaaaccaccgtgaaaggatacagcctagaacagtgctgtccaattgaaacagcaataatttttaatggtctagtagctatatgaaaagaggaaaaagaaacaagtaaaattaatttcaatattttacttaactaaatatattcaaaattgtatcatttcaacatgcaatcgatataaaaattggtaatgagttattttatattcatttttactaagcttttggaatcgggtctgcttttactctttcaatgcatctcagttgggactagccctattctatgggctcaggagcctcacgtgggcaccatgttggacaggagcctcacagggctagtggccaccatgctggccaccacgctggactgcgcaggtctacaaggaccctgctgtctgaggactccttgcacgatgcagagttcagttaagggtccacagaacaaaagcgacagaacacctccaatattttagaagaaagtaggatgaggtgagctggggacatggggaagattagaaaattaaacctaatcttttttttttttttgagatggaatttcactcttgtcacccaggctggagtgcaatggcacgatctccgctcactgcaacctgtacctcccaggttcaagcaattctcctgcctcagcctcccaagtagctggaattacaggtgtgtgccaccacgcccagctaatttttgtatttttagtagagacggggtttcgctttcgccatattggccaggctggtctcaaacccctgacctcaggtaatccgttcccctcagcctcccaaagtgctgggattacaggcatgagccaccacgctcggccgaaaattaaacgtattctaagacaaagaaattcagattttttttttttcgaataaaggatgctgtgtttattttcagcctttggacgacccatatgagtttcacttcacactgtgttgaagaaaagagctgcaggggacagaaaatcagtcaaattaaagaaaatatgaggcgtaactgccctgcagtgagagcatatgaatttttctgccacacactctgagtcatttgttaaagaaagccagagaataagaactgtcctgggttatcgctaactttcactgtgtctgatttacttgtttgcacactttgtcaaatcttggaccagggacagatagcgtccaggccattactcaaggggaagactgttgatcagagtacactgcaaacaaacatctgtttctgatggctgcagcaccatccttcattatagaatgagcttaataaacacgaagtcatagaaatccaccattcacgtaagttttggcctggtgttattgcagtctcttaatttagccaacaaagaaggttggctcaaagacacctgtttttgcatgtaaagtatcaggctggaaggcttggtcgggcatggttttagcaacaggactttcatttgtgatagttcagtcacgtcctggggaattgaggagaagatccaccctaccaaaggccagtcttgctttagcaccaaagaattaattttaaaagttagagttggccgggcatggtggctcacatctgtaatcccagcactttgggaagccaaggtgggcagatcacctgaggttaggagtttgagaccagcctggccaacatggtgaaaccgcatctctactaaaaatacaaaaacgttagctgggcgtggtggtggacgcctgtaatcccagctactcaggaggctgaggcaggagaattgcttgaacccaggaggcggaggctgcagtgagccgagattgtgccactgcactccatcttgggcgacaagagcaagattctgtccccactccccaccaaaaaaaaaaaattagagtactgatctggatttcacccttgaagttaagcacacactaatgacagaagctgaaataaatcccccaaatgtcttgaacactttctaggcttgtgtctctccatgagattctcagacagctgcatttggatttccgggggctggactggatctcagatgtttctggcccagaacctctgccctaaatgattattcatgaatgttctggctcaaaggaggagagagaagatgagagatccagaggtctgagatgtttgttcacacaccaatctctggagcggaagccgttaatgcttctacttatattcttaaggcctcttaaagaaggttcccagcttggggctgggtaataatggtgagagcatttcccacattatcctctcgatatgcatctctgccatgactatcagacaatggtgagagccagaaccacttagagagctgattgtcatcaccgccctgacagtctcagtggcaggccaggctctaaaggctcctctggatgcctgttggccaaagataactcatgcctcgggggtcgtgagcaggaggtgaagccaaatgccttcagtgacctgaaaaatgctatctcccagcaacatgcacaccttgcagtgtcttatgaaattataaaataaaacccagacttataagactcttcccctgcctaagttttctttttctctctcaattttattgctttgctaaggacatagaaagcaaactaattaaatgacagctaaagagcaagtgactgtgtcccagggcggctgagataatgcgcggatctcaggtgagtcgaggaaatgccacagacattgctgcctctctactaataaatagctttttggtcccataacatgagagacattctggaagctgtgggggagcaaaagatggcttccctctaccctcccaggttctttggctgggctattgattaaaatggcatataaacagattaacaggagaaagagcatattcaattctgtacacatgagagtcccacagaatatgagactccaagaagggttagatcatggaagcctacagaactatatcctagatacagaaaagaacaggggcttggggattcttgtgagggggaggaggttagaggagggcaaggagaggaattgtatggtgaataaaggttgtcttattatgtagataaacaatctctcaggtaataaaagttgtctccgagcagccctgagcagaacaggcagtagtctctccaggcatggtgtccacgtactcatcttccccggctgacacaattccctgggaggggattcacgacaactgagatccatcaattgtatttgcagagaagctagttcagagaaaggccctccccgaatttgctgttccccaagtgtcctctgttaaggagtcagcacaccaaagcatcatattttgaggtggcatttcctgaactcctgcaaagctgaataacaatggagagtgaagcatcaactgttctcagtgctgggcgcccttcctccctctcgatttagtggcacagactgttagaactgcagggccctcagagagctgatcatctgtagggtagaatactgcccctttttcttctggctctcttaataatattgggacctaatattctatatttttaaaaattgcctaacgacatagatcatggcaaacactaaaaaagcacaaaaaagccagattgttttgataataacaatgatctaactccttattctttgaaatcccatctctgtgatgagaaccaaattttcaaaaggctaatagctcataaagggccctttactgttgtcctgtggagaaacggaaaaacgctcatggggtcggttattgttccaaatcaaatcattcctttatctcacaagcatttgttgagaggatgcttctctctggcagtgcagggcctcagggcaggagcacgtaatgactctgccccatctctgtgagaatcactctctggagagccacgcttttatcctctgctcctcagcctatcttctccctagccctcctttgcctagatgacttggaatagggattgctatggtttgaatgcttggcctctctggaactcatgctgagattttattcacgtgaagtctttcagaggttattaggtcattagggctccaccctcatgaatgcattaatgctgtgaggtgggagtgggttactgtgggaggagctttgttaaaaacctttctctctctttcacacatgcctttgcccttctgcctatctgctgtgggatgatcctggccagatgccagcatcatgctcttggacttcccagcctccagaatcaagagccaaataaacttttctttataaattacccagtctgtggtattccatgtagcaacagagatcattctagggagtactctgattccccattaggaaatccctttgggcaaacctccctgaccccaggcctgggtttgctgtttctcctgtgtgttctcaccactctgtactgacctgatcctaaatccctccaccctgcactgggtatttccttatccatcatccctactagactcaagttcccagctctctcaccccatgtgttctgagagctgctatctaagtacttggccctgagtaggagcttaataaaggtttattctaggaagaaaagaaagaagaacacaggcacctagacagaaaattgtgtggcaacgcatagacgggatgacagaggttagagcagtcacagaggaggagatgattgctctccctggacagtctgtccaaattccacagccccagtgacactttgtgtcttgaagggtaaacaagattcatcaagacgcaaacaagacaactctataaattgagctaatatcatcagtgtccatgagccactgaacgcagtttcttgtctcagtgaccccaatggcatctgcaaaatttagttaagattcaaaattaagagaacaaaaatgtgtcagggtgtctctaagtttacattatctgtaagaattcatttctatggctctgtgttcagaaagacttttctgcaggaaaatttatcatggtgtatatcactccctgcacaatgacgcaagtcaaaatcaagcattttccatgggaaggctctgtttctaaggattgaaatgcttattcagataagtcactgaaatggcacagatggccacacctgcccctttattgctacagagaacctgacatcctctttcaagtcggtagcaacatacttctaaaaacagaatgcgaagccgtaaatactgcaatggaatggagttccagcagaaaagtatatgtttctgtaaagtcataaaaagggggactaattcttctcttactgggatggtctgatatacgtttaatgttttatattttcattgaaggcaggaagatagactaaatgataacattgcttcccaccttctcctccagctctgactctttaaactgaatgctgatttatctctccaaatatctcacaggcctttactttattatgggccaggaacaaatggcagtgggtgaaataggcttggtcacacagtgacaagatttacaatgggatttgggggaaaagtcattagtcgtcatttgccatcctgtgttcatgcccctctttttcaaaattgctgtttaaaagtgggtctgactgggcatggtggctcatgcctgtaatctcagcactttgggaggctgaggcaggtggatcaattgaggtcaggagttcgagaccagcctggccaacatggtgaaaccccgtctctaccgaaaatgcacaaattagccaggcatggtggcacacatctgtaatcccagctacttgggaggctggggcaggagaattgcttgaacccaagatgtgcaggttgtagtgacccaagatcgtgccattgcaccccactccagcctgggtgacaaagcaagaccctgtctaaaaaataaaataaaataaaaattaaaaataaataaataaataaataaataaataaataaataaataaatttgggtccaccataatcagcattttgggccagcttccaggagaaagggaagggaaactgagggtccatgagtgctcacagccaggcaggctcgtgttccaagtctcgtacccgttgggccatttgagaagtggcaacaggggatcagcagaagggttaactgccaagtctatgcctgttcctaccaatttggcagtccaaatagatttttcttttaaagtagacttttgctcccactaatttggaaaatgatgcttttctttgctgaagaggaatgtcaagttaatttcaaggatctaaaataaacatatatctgacactggctcagcatgggagtaaacccacctccttaagagcactgggaaagaacctgataagggaagctggggattggtctgtggatggaaatgaccctcacaatctcctggctttatgttttgttcctttatacatacgtatatatatacacatatatacacacacatatatatacatatatacacacatatatatacacatatatatacatacatatatacacacatatatacatatacacatatatacatatatatatatacacacacttgatttgaggtgttggtttacagtaaaatcttcccacttagcatctacttttctcaatttttttcaaagtcatgaagtttagtttgatgttatctaaaagggtgctgatccactatgggcacattttagctatttttctcaaatccaccaaaaacgtaaggtggttgctttcaagttcttcttttagggcgagatgtctgctcagtatatagaaactttttaaatgcttcaatcactgtaacttgataggaacttcctattttgtttctttgaatggtaccctaagttctgctttataatatcagtaaccacaggattttgagtgcaatgctctatatagcacaacaaagtggcttcttagtattagcccgaaggaaatatgttttgggttaatggcaatacagtgactttcaacaaaaactcctttggccccagtcatttccattctctgcaggcaaaatggatccttctctctttgtgttcagtgatgagcaagcatttcaaatgtacatacaacttgtttctgtcaatcagtgattcacgccgagtcatgttcaatcatgttaccacaatctggaatttgcaaatctgtaagcatttctcaggcaatgaattatgtcaacacaattgcaccatcattgatggacttggaaatgcagacagaactgaagaggagcgtctcggcactgctgctacgggtaaggacagagcttcttgctgacttggaaacatcatgagcttaggccagccaaggtttaggctcgttggatatttttaacaaaatgggacttcagagaaatttaattaagatttatttcaaattaagatcaccaaattatatttacataaaagcctctataatgagtatgctatatttgtcattaaaatgtctttatatttttataaatatggtttcacaattttttacagagtcataatctacatggaaaacaaaaagtcataccaaaattataactgctaagagagatgttaatggtaattaatcatgagtgagtcataaatatagaaacgcactgacttgataaataagaaacaatattgcttctcatttggcaaagctgaaaagggaggggctggggaagggggcagctgcactcggtgggaggctctgcacactggcacaattgtttgctgggaggtaatttaacaggactgaaatgcctccattctaagatgacattaatggtaaaaagcaccttcaatttaatagtggcttgaccaaagaaagaaaagctccatcatactaccattgtaaacatccacatcaatttacaatatcctgatttcagaaatgttaaaatacacaaaaaggtacttcttagagttgaggataagtgttggatgcaaagctgtcaggcctctgagtcgaagctcagccattataacccctgtgacctgcacatatacgtccagatggcctgcaggagccaagaagtctgaagcagccaaagaaaaaccacaaaagaagtgaaacagccagctcctgccataactgattgaccaaccttatgacattccaccattatgacttgttctggccctgccccaactgatcagttgaccttgtgacattcttctttcggacaatgagtcttatgatctccccaccatgcaccttgtaatcccctcctctgctaacaatagataacctcctttaactgtaactttccactgcctacccaagtcctataaagctgcccctctcctatctcccttcgctgactctctttttggactcagcccacttgcacccaagtgaataaacagctttattgctcacacagagcctgtttggtggtctcttcacatggacaggcttgacaaaagctttaaaaacatgcacatgctttgactctctaacttcctcttctaggaatttttctttttagagaaaagtcaggaacacaggaaaaattcggccgtgggaaaattatcatcattccgcaagatacacatttacataagtcatggcacaccctgacaaatggtcatcattaaacatggcgttagagaaatgcaaagatgtttgtgacacacaattaagggtgaaaaactggtaaaaaaaaaaaaaaaaaaagcccatcagcataaactcgtctctgttaaaattgcggacatgtgggtttgcgtatacatgtaaaacgtatctagaaagctctacagcaatgagtcaaaaatcccatgtccagccacgtgggattatgtttgttttctaggttttccttttttttttttttttggtacaatttactgacattgtctaatgagtatgtattacttttgtaataataaaaactctttcatttttccacttaacaatattgagggctgatgagcctgtgccatgggtcagggggtcggcgaggctgataccgggagtggacatgtgtggaatgcaagtaggatctgcaggaagaaaacagttgtgggaatgctgttggtggcaagatctgctgtgtatgttttgtccccatacaatgtcactagaaaccattcatgggcattaaaaaagaatccacaatgacatctcttttcattatttcattaaaataaaacattaggaaatagccaatgaaatcttatctaaaatgaggtggactttgcccatttatatgctatccccccaagtaattcacaagcatgcagcaagacttgcagatgctgtattaaggaggccacattttaattttaatttttattttttgagacagagtctcgctctgttgcccaggctggagtgcagtggtgcaatctcagctcactgcaacctctgcctcctgggttcaagcgattctcctgcctcagcctcccaagtaactaggactacaggctcccatcaccatgcccagctaatttttgtacttttagtagagatggggtttcaccatattggccaggctggtctcgaactcctgaccttgtgatccacccgcactggactcccaaactgctgggattacaggtgtgagccaccacccccggccaggagaacacatttttaaactctgtggtaatggttgagaatactcttcattactacaagcattttggacagaaaatctctgagacgatgacagcattgtgtgttctctaaagcgccaggttataacggccatatgtctccctgagtaggattttccagaagaaattaccaaatggcacacaaaaacgcagtgtgctgacactaatacataaaatgcggaaggacccagtctttccagagtgcccctttctcaggacatagacaagtagctttcctactgacagcacctctcagttcaaaggaaagtggtgtgcttgctggatatttttagattgccagaatgttcagtggaatcacataaggccgtcactataaaaatgaaagcaagcccaaccttggtgtgatgttttgcaataaacagcaatccatggaataagaatttaagacccaatttgaggtcacgtgctgcaaacccagtgttctttcagagtcaggtcgctgttagatgacaaccccttcagcaccggcctgaagaaagcgcaggcccagtggcagtctgccttctgttaattcccaaggttctcagcattcctcagatcaatagaactgtgatgtatctatataaatctgagtagcagatccattctcataaagtttaccctgtcttgcttttcaggtgagaagcagaattggaaaatatttcagggagtatttgaaacaggaagattaaattctgtctcatgtgtatcatgaataaaagtgctaagccaggcacagtgacctttcctgtacctgtgctaggatgcaaaagatcataggtgtaggctctgggcagcccgtgcatctgctgggtcagcggtctggcactttttttgagtgtctgctgcccttgaagaaggggatggggaaggattgcataagttgtggcagggggcctggggcaggtgggtggccaggaatctgaaggagagtgaacatgagtgagagtacgagcatgtctcagctggtagcccttgtcccagagctggtggcctgctgtgtcctcctccagtgtatctgggagtggtggttgatgtgagcgccatgctgagccccgctcatacccactgggcccagctctttttcagtcctttcctggcctgggggaagcacgtacaatccctgagctatgaacagtggcaccagcttttaagtaaggatgagggcttcccaaccaactgtaagggggctgctggtttgagcttttcaggtttcacagcaagctcttggtcccctaaggccctgctcctggcagatactctaaggagcccgggtctgagctggacacacacagcagcgagaggggaagggcgagctatttcctccattctggtgctcatcgtgggccatgcgttggttacaaggaagcagatggagttggggaaacatggaatggaggatggggaggatgcagggaagagaatcggggtcactgtgagggaggggcaacagtgccatgggaaatgcatcattggtgctcatgacaacggcacgccaaggggcttgatggcagcagcctcaggtatgggcagaacgttgaatcctcagaatgatatgggattccttaaaaccaagcaaagcaactcatcacctacccataagaataacagaaagggccactcgatggtttgatcatgtttacaaaatctggctaaacaggaagtttcatcctgaaaccggtttcctcaggtggaaggaaggcagttgactcatcctgcttccctgtagtagattttatttttcagataaaaaacctaatattatcagcggtgatataaaccagtgcagggcctctgggatgctggcaaactctagtttcactgtgaggcaggatttagggcctctgtttttactcatgagaccctggaggctctaggtcagtgacatggcttggctgtgtccccacccaaatctcacattgaattatagtaatccccacacgtcaagagtggggccaagtggagataatcgaatcatgggggtggctttccccatactgtccttgtggtagtgaataagtctcacaagatctgatggttttataaaggggaggtcccctgcatatgctctcttgcctgccgccatgtaagacatgcctttgctccctcattggccttccgccatgattgtgaggcctccccagccatgtggaattgtgagtcagttaaacctctctccttgataagttactcagtctcaggtatgtatttattagcagtgtgagaacagactaatacagtcagagagtctgggggccatggcgacagggatgcctaagagaccaacacagtgtctgtctgcgaactcactcattcccttctcactcactcctccactcattcattccttccttactcattcctccattcactcattgcttccttgctcattcccccacttatgcattcttccactcattccttcctcactcattccttcctcactcattcctccactcagtcattcctccattcactcattccttcactcactcattccttcactcactcattcctccctcactcattcctccactcattcattcctccactcactcattcctccctcattccttcctcacccattccttcttcattcattccttcctcattcattcctccactcactcattcctccactcactcactcctccctcactcattcctccactcattcattccttcctcacccattccttcctcattcattccttcctcactcattcctccactcattcattcactcattcattcctccactcactcattccttcctcattcattcctccattcactcattccttcctcactcattcctccactcactcattcctccactcactcattccttcactcactcattccttcctcactattcttccactcactcattccttcctcactcattcctccactcactctttccttcctcactcattccttccttcctcactcattcctccactcactcattcctcctctcacttattccttcactcactcattcctccactcattcctctgctcactcattcgtccactcactcattccttcactcactcattcctttgtcacttattcctccactcactcattcctccactcactcactcctttctcacgcattcctccactcactcattccttcctcactcattcctccactcactcactcctttctcacgcattcctccactcactcattccttcctcactcattcctccactcactcattccttcctcactcgttcctccactcactcattccttcctcactcattcctccgctcattcattcctccgctcactcagtcctttctaacttattcctccactcactcattcctcggctcactcattcctccactcactcattccttcctcactcattcctccgctcactcattcctttactaactcattccttcctcactcattcctccattctataattccttcactcactcattccttcctcactcattccttcactcactcattccttcctcactcattccttcactcactcattccttcactcactccttcctcactcattcctccactcactcattctttcctcactcattcctccactcactcattccttcactcactcattccttcctcactcattcagtcagcaagagcttattaagcagcagctatgcacgtgtccctgtggcctgtgctggagaaggaacagtaatcagagacaggctctgtctgctcttgcctgccttcctgactgctggactagaatctcgcagggattgagctttattctggcagcaaattcagctcctttggaaattatattaccttttctgaacacctaaataacaccaggaggtcaagtacgtggaagtctgaggggcggaggaatgtgcatttagggtcgtgggaccccttcccatttatttgtggaaacccactgtctcccggacactggcctccagggcacggtctggagggtctgtaagactccccgtgacattcctgttccttgttccactgccagggtcctgtcctccctccgctttcccttcacttcctgagtctctttccattagaagaagaattcatatacacatactgcagcaaagggaatgacagctgcagcaggtcgccagtgcatcaacacagagtaaccgaatacatcagagaggacatagggatctggccagctgggaatggaagccaagtgggcatgctgcagtgagaactgggggagaaggccggaacctggcgggctcatgtgggcacgctggccatggtgggatggcagcgtgggccaggaaagcctgggaactgggggtgttggcatgagatgaagctcacagaggcatgggctgcaccgggtcccagggacacctgagcacgtctcagggcgccttctgttcacagcttcccacaggagtccagctgagaaggaagccacatggccattcctgagaacaaggataatgccacacaaatgagatgttccagctccctagctctgaggaagctcattcaaaaatgcaatttttaattaaaagggaaacttcctgagaggacagggagcatttacagcatgaagtcaggcagggtgagcctcacccagctgctgttcctttctctttcctgccttctgaagaggagactgtggaaagggaagcgaggcagaggtggcagaaagagatgataactccaggaaggaaggggtgcctgagagaagcagccaggcagagcggtgggacgtgaaactcctcgacagcactgtgtcctgggccgaggtggggagggtcagtgagggcagggtactggtgtcattttaattcagacttctctctttctttgctgcaaatggctctctggagcacaaactctcaacaaggtggaaactcgacactatgctctcaatctccatgcacaattttgcagaagaggctctttccagcattttctccccagatgtcagagccgtgcacccttctccggaaggctggagggtgttcagcgttgtttgtcacaggcagcggccagtctctgtgttctcgggcgctctgtgtcaggtcctggtatttattcccagattctgtttagatgcacccgaggccccaggcaaaggtttctgcctgagacagtccttggcctccagccacggcttccgtgccatgtcccaaatgcaaagtgccactctcaaatgttctctgatctcctgttcgaagcaaataacagagtgctaaaatcttatttagaggagtcgtggtagaattatttattcacttctagccttttggctgagactgttttgaaaaatagaaaatggcaggtaattcaggtgtcacccttcaatggcatgtgttcttcttgatgtttcacagctactgcacatctgatgaagaggattttttttaactgagtaaggtcatcttttcctgatgaagccccaaagtgcaaaaggcatgaaaggcacattatgcttctccaccagaggagggtctccgcaggcagggcagccgctgaacagcaccgggagggtctgtagttgccagactctattattgtgggctataaattaagaggcttccgtttcaaatacaaactctctcatcagtcacaggaaattaaatgccttttgaaagggagctaggcataggaggaattcactttcttccacctacacactgttggcagctcctcagagggaaggacggagcctgccattctgcggagcgtcacctggttcttacccacgacttcaccgtgagtgtggagtccacaggactccagagctctgtggcctgactgcagggcagtctgctcccaaagagacttggggagaacatggctaactcaacagaatacagaataacaccggagaggggcaccaagagagtggtgatcacataattgagacctagtcagacccagtaacaacttaccgtgtccgcgaggaaccattcatgcagagaggcctccccattttctgccttaaactcattttatatacgtggggaattgagactccaagattacgaacattttcaagatcctctggctagtaggtgatttagcttagagtcaaatctagatttgaacaactccataatcatcataataaacaataacgacactacctacatgaactgagcaatggctaagtagtaagcatgtgccgaaccctttacgtgagtcaacttagttgatcctcagataatcctgcggcagagtgattgttccagccacagatgaggaaacgcagagccttccaggtgttataactcttttctcacgcctctcttacaatcctcaggaaatgtcgcccccccccccccccgaccccccgccagcccccgaccgcccggaactaagccacagccacctcctgccctggttgctgcaatagtctaatctctcctggagtctgcccggcccctcctgagcttcgtcccagacagcagtcagagcaggacttcagatgttgtcagttctgctctcactccccgccactgcccatttcactgggaatgagagccaggggtcctcaccaggcctccccactgcgtccctctctccccacagtgtctcctggagctgcattgctctctggatgtgccagaacatgccgtgggctttcatcctgcgtcactcgactgggaatgccctgggatcctgcaggtgcccacccagctggctccctccgggtcccgtctttactcaaatcgcaccttctcgatgaagtttactctgaagttcaacctgctcttcccatcctcccaccccaggcgcagcagatccgccttaactggactcccccgctttgcttccacggcgcctatggaaatgctctgacacagaggtcagcgaaccactttacaatcacattttactgggacacagccacaccttttggttcgtgtattgtctgtggccactttcacagaatgaccagtggccctcagagctaacagacgcactgcctggccctttactgaaaagtgcggccacctctgctctaacataactggagagcttgatgacggattgggcttgtttttctcggtctgttttcccccgaggagagcgcacacactggggggcaggaactttgtttcttttgagcactgacgcctcccagtgcctagaacaggacctggctcgtagatgatgccagttcatatttgttgaataaatgtgtgaatgaggcatatatttgctaaacaactcacccaaagtcactccagtgataggcccatcagctctcggcatccaaattcaaacccaggcagaccaacagagagtaatagcaacagagacccgttcttaccagtgacccccgaccagcctcatccgctgctgcctcgcaggagacagtgtcctatatttgctcataaaaaccaggcagggaaaaaggcaagctaccagcttttaatcttattaatatgggccagaaaggatggttcatggttctgaccataagacaaagtgcttcaaggcaaggcttgtatcaaccgtgctacggagttgatacacaccgaactgtcacccgtcctcctgcccaggggccttggcgttttgaagactcccccatctagacgtccagcagatgctgagcacccaggagagaggtcagaatgcaggatttgcattgaaagccacgtctattggggaagcagctaaagctctggaatgaggtaccagaaagaagaaaggaagatggaggaaagaactctggagggagatggggccgaggaaggagtaggaggtgtggctatgctagctcatgctcacccctcattcaagctccagacctgggccaagagcaagaagagagcttgcttgtgggtccagagtttctgatggcagcgggtttttgatggcctgtaaagtcatctaacgggcttggcgcagtggctcacgcctgtaatcccagcactttgggaggccgaggctgccaaatcacgaggtcaagagatcaagaccattctggtcaacatggtgaaaccctgtctctactaaaaatacaaaaattagccgggtgtggtggcgcctgcctgtagtcgcagctactcgggaggctaaggcagcagaatcacttgaacctgggaggcggaggttgcagtgagcagagatggcgtcactgcactccagcctggcaacagagccagacgccgtttcaaaaaaaaaaaaaaaaagtcatctaatgcctccaagaccacacgctattgatttaatctctgaattaaaggtctctgaattaaagtgtataaatgtaccttctcccataactctgagaatggggtttgtgtcttagaaaagaaaaaactcacggggctgggggttacatctattgtttcctgtaattgtcacagcagtactcaatacacacattttcacaggcaaggaaactcaggttaaataactttcacaacacattggaaatttaggctgccaattagtcatccctccggcccccctgggttttaacctctagacctagagaaccaaattagatgaaaataccagcttttgtaaatcaacagtgtctaataatcccccaaggacagggccctaggcaaagctgagctgggggaatgtagacagacctcctactttccactccaaacctagacgcagactcagtggcccacccaggggcatgagtaatgctgggagctgcaggctggcttcccacgctccctcctgggcctggcccccaggcctggctgactccatggggggcctggcagtatcacagcgcagggctctcaggctgccagcagagcagctgttgtgttttcagctgcttattctcactaaaacttctgataaggccatctggaaaagtattactgtatattaataaaaatatttaaataaagttacagaatggagagatttactttggaagtattaatatgtaatgagttagacagataacgtgtttgaagcagcctctgccaatctgtttactccacggagagaagaagaacaggtgtgtcaagccaaacatctttccttggcacttgaactgccttacttggagcagctctgacaagcttatttttgtggtggtggttgggggaacccagcatttttagagaagaaaagagcaatcttcactccagaaagtgaatctgtctatattcatgtatcggccttgacgtggtttgatttttctttttaactccagtgttggttctttgctctttgaaatcaaaacattctgtattatttctgggattatacccagcaaagtgagaacaggagcttcttttagtaaataaacgtgatcatcttccgccagtaggtgtcactgttcatttagcacaaaccatacccgaaaggcaaggcaattacctcggctaaaataacaagcatgttttctggaaataaaataaccagtaagtactgggaaaaagattattttctttcacaggtgtctccaaatcaaagctgaagtgtgaacaacaattcactctttctatggcctcccacatagtatttgcttctagagctttagcaccattgtaagaattccttctaaaccatgtttgtacctcagatctaactgcctgaccctataaacattttgcggttgactttgcttataaaatgcattggcattttcacatacaggcggtggagttttctagcgttccagcctaaatcagaaaacaatgtctggtgttgcctacacagaaacaatcgtatatcatagaaaattagaagtgaggcagtaaagcgagtctctgaaaatacgttggatgtaaacacatcgtttacatgaaggacatggaattataagttcacacagtgacacacaaatatgtaaggtcattagtgttcactaaatgcgtagctatgcaatgaaaatggtgagaatcctttacgagctaacgtgctacacagagtttgatgcttcttgtgcgtgatctcacctgttcccccacttatgtgaccattttacaatgaagaaatggatgtttaaagaggacagtgaggtccctgcgccacagtggtagaaagtgaccaactagcagtcaaccaggagatttttggccctagaacctgaggtcctaaccacaacacagagggcctttccttttttcttttttcttcttctttttttttttaaatggagtctcgctctgttgcccaggctggagtgcagtggtgccatcttggctcactgcaacctccacctcctgggttcaagcaattcccctgcctcagcctcctgagtagctgggattacaggtacacgccactgcgcctggctaatttttgtatttttttaaaaaacggggtttcaccatgttgaccaggctggtctcaaactcctgacctcaagtgatctgcccacctctgcctcccaaagtgctgggattacaggcatgaaccaccacgcccagcctcctctgacttttgtaagggaaataattagattctgcttgtgttgaataattctagccaggccggagttcagttctagtcctcctacttccgactgatagtggctctgagtagttcacttaccatctctgaatttccatttatttcactgtgaaagggggaaattggtacctacttgtgggattgctgtagagattcaaataccgtgtttaagaaagttcctagcactgcgcctggcacgtaaaaggcacttgtttaagaacttgataaggctgggcgtggtggctcacgcctgtaatcccagcactttgggaggctgaggagggcggatcacgaggtcaagagatcaagaccatcctggctaacacggtgaaaccccgtctctactaaaaatacaaaaaattagctgggtgtggtagcacgtgcctgtagtcccagctacttgagaggctgagacaggagaattgcttgaacccaggagacagaggttgcagtgagccgagatcatgcgccgctgcactccagccagagcgacagagcgagactatgtctcaaaaaaaaaaaaaaaaagaacttgataaagtaaaaaaccctgatttttgaaataaattaagagtaatgaatatgcaataaagcattcttttctgaaatgcgttatgagaggtcaggagttagtcttaagcagttttcaaaggtgcaagggctggagtggcctcagtttatctggataaaatgactatatatgaacagagatgccaactgttggtgccaggcatggctcatgggcttttggcatgatgaacagtttcctttattttcttttttttctttctttatttatttttgagacaggattctgctctgtcacccaggcgggagtgcaatggtacaataacatctcactgcagcctccactttctgggctcggtgatcctcccacctcagcgtcctgagctgggaccacaggcacgcgccaccatgcctggctaatttttgtattatttgtagagagagggtctccctatgttgcccagtctggtttcaaacttctgggctccagtgatttcccccccacatcagcctcagttttctttactttttaaaaattaagatcctgattttacaaatgaagaaagctcaaagatgaagttacatgtccaaggtcacatagctgaagagagaatttgccgggctgctggatcttgttttttccatttgccgtactaaatcatgtgctacaatatttgtggttttcctcaactccacagagcttgcttctctgaaattcctattccttgctaacccctaattttgtatgtgaaccattggagacagggagcacaaaaggacagcaagagagaaagcaataaactaagtagagaaaggaaggatcctcctggtccttatgcctttgagtgatgatgtaagaaaatcatgtgaagttcacctgggtgagcctttaccctccaggcactcgagggcccataccccacaccaggagagttgaggcattcctcatcttgattttgaattgatgcttgagtgggggtacttaagtattaattgaaacgtgctgaattcccaacataaatggaaattctcaggtgactttgaatggcaaaaatcagtcctttctagacaattaatgagtagatatagaatttccatccaaaagttgtagaaaagtggttagaagggagttgggtatttggcagttaggcctggagtttactttctgggtcagaaccaatgtcctgagttcatgcagaaatcacatttgatcttcactaaaaattaagcaggaccagcatgagggtggatagagagtatgttgtatcttctgtagttacagcataacttcctttccccatgtagcattaacgggggaatggaggggactccggagatcacaggaagagtttgttcagatagagacgtttaccccttgaactgtttccaaccctggctgttgtatattattctaaagagactacattagatatttagggaaaaattaaggatagtataaagttagcataagaagaacttttgtgcagggtctacacagaagaaatcacatgaagagtttaaaaagtattttttaaaaagttaaaattttgaaatacgttcttgaaattctggattcagtatagtcagagatttactatcagtggtgttgaagaaattcttggtatattcttcagcaacagagtggctatgataatggaaaaaggttagaatttagtgaatttcagaagtaaagaattttgatagaaaagaacaactgaagttctttggatttctatgtagcatttctgtttaacgagttatcattatagaaacataatctagtaaaggaaaatatttttcaagttttactccaagaaatcatttgagataactgtggcaggatccacataaaacttattagccaaggattctacttagttccagttgaaagtaaaacagtaataacccaaaataaccgactaaggaaacacaaataaaatctttttttttttttttttttgagatggagtctcactctgttgcccacgctggagtgcagtggcatgatctcggctcactgcaacctctgccttctgagttcaagtggttctcctgcttcagcctcccaagcagctgggactacaggcacccaccaccacacccagctacttttcgtatttttagcagagatggggtttcaccatgttagtcaggctggtcttgaactcctgacctcaagtgatccacctgcctcggcctcccaaagtgctgggattacaggcatgagccactgtgcctggccagacaacacaaataaaatcttgagaaaattaactttacacctatctcctctctttctttgactaacgcctatattctcatagatgctctgtttatgcttcattttcttgtttcttttttattccccctttctctgctgaaagaattatgaagaaggaagaaaatttgaaaggaatagaggaaaataggaaggaaaaatagaggaaaaaaggaagaaggaaggaagaaaggaaggcaggcaggcagggagcaaggaaggaagagagaaaaaggaaaaaatgccccagaggcaaatgacatattttcaaagctacttcttctaggctggtaatttcccagtgccctgaccttgcattccagacttcaataaataaacggggatgatgccaatgatcgagacgccaacagcagcccttttctagggctgacatcgactgccacatcactcacagcatgtggaccaaaatatgagacaagctgggcatgcattcagacattttatttgtgtcttttagaaagcatttatatttcctataaatccatttacatgtcagtatcgtagtgagaaatgcacgcactatgagaaggccttgaaacatcaggagctgcagcactcttagagcagacttgacagctgcactgggtgtgagatatcagcatctttaatgtatgccagccttgcatgggtttggttgggacgtcctcatctgagaagacgtggcccccaaatgaatagggaggcactcacgttaatttttctcaactagtatctgaagggttgtcatgctctctctgctttctaatgtacatagaggtgtctacatgcaaacggatagcagctgagacacgctgtgtaacttgcagcttacatgtaaataattcggaggtgagtactgcgatgcagttacacgtcgtaaccacctgaattttatgggggaaccttctgcacgtattcatgcatgaagaacacacatttgaacaggggcataggcagtgtttgtcaagctctggaatgtggatgacaaaggacatcttaaaattccttgatttggggccaatgacaagcaagacatttacagatttagatgacttgtcaatcccaagctggaattcataaaattggctggtctgtttaaagctgcctctttctggaagcttcctctgcacactctagctacagcagggccttaccatggctcattgtcccaccagtcccttccactgctcttgttcctggtctcataggctacacacaaccactatcatctttctccaccatttgtctagaagagggaggggactctgcctaggtctcatcattgtgtatgaattgacagaacagtgcccagtttacaggcagtgctgaacacagatcagttaaatgaatgaatatgatctttactattaggtttctggtgattttctaaagtctacagacaagaaaagcactggccaatgaaggtcaatgtcaaagcacaaggctggtattgagactggagtacggcatgtagtgttgaagataaattgaggcatattaatattaaagagttgatttgaggccagccatggtggctcatgtctgtaatcccagcactttcggaggccaaggtgggtggatcatttgagtccaggagttcaaggccagcctggccaacatggcaaaaccgtgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagagggagattctgtctcaaaaaaaaaaaaaaaaaaaagaattgattttgatttgagcaaacagcaatcatgggtgggccagctctggatcacaagtggttcatggctccacagaaggggcaaagaggaaggcttttatggagtgaactcagaagcaaggcaaagaattcatcccagtggaaagtcccaagttagggcttagctggctgtttcagattgtcctagaacatgaccactgagttgggtttcagattgcagacacaggaactcagggcattggggccaccttggtctagcaggcttccatttaattactttaacagcaggaaccacaggacacctctaactgtccttaagagtgtaattatagctctttggccactccctgtactaaaaggaggagtggagaatttggagaggatgtaggcaaaaccactgtgagcaatcaaagtatcaaaggaattaactcatctaggaatgcatgttccttattctgcagtacctggaagggcttttggtgtgtgacagcaatgtgaagcgtctttacatcttaattctaagagacagcagccacgatgtgggaagaacttcctagttaaatgtgctctgaaaagttggactgtactgtcgagggagactatgggagtttctttgttcagaaacacttaagaaagtactcataggcccacattaagtaagtgatgcctacaggtgtcttctgtttctgtgaattggtgtggagaacccaatgtttattgagtgcctatgtgctgagttaggcatgactctctttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcacagtacttgtttgtcctgtctaccagcaacccttcagaaagagtctccattgacttatttcagaggcaacaaaatgagcttcagggagagatggtgtaggtccgtggtccgattggtgtccaacgctggtctcaaatgtctcagttgtccttgtcttttgagatcagaatccacagattttcatttctgatgcaccagatcaaggactagtcccccttggctactccccagtcagacatgataaaggtgcctcatcacccactggagaggtgtcttcagggggaagtcaagattacaactaagtatcttttgggtcaaaatgtttgtaaagtattatgaggagatgaatttgtccaaatactcaaattttgtgctttgtaaaacacagtaggttgtataatatagacgagacgccttgccacatcagtaattccccccatattcacacggtgcccctgttccttggaagacatggtatttttttaatagctcatgttgggcccacaggattcctgaaaagtgcagtggtctgtcctgtcctccttttagagactaatacccagcctcagttccaacaccgagcaggagtgacagtggagtgttcccacactggatgttcaggggaattaacaaagatgagtgatggcctcccaagtggttaagggggtgcctgtgtacagcgttgtaggagcaaaaaatgtgatggggtgacaaatttaaaggaaaacaaaaagaggaagagagaaaaacggagatttgtaaaaagcaagagagaaaatgagatgtcccactgcccctgaatacccaaaggggcgtgctgaagtacctcagggatatgattctatgctattgtgatggttaatactgagtgtcaacttgattggactgaaggatgcaaagtattgatcatgggtatgtctgtgagggtgttgtcaaaggagattaacatttgagtcagtgggctggggaaggcagacccacccttaatctgagtggacaccatctaatcagctgccagtgtagctaaaatataaagcaggcagaaaaacatgaaaagactagactggcctagcctcccagcctacatctttctcctgtgctggatgcttccggcccttgaacatcgaactccaagttcttcagtcttgggactcagactggctctcctagctcctcagcttgcagatggcctattgtgggaccttgtgatcatgtgagttaatactacttaataaactcccctttacacacacacacacacacacacacacacacacctcctattagttctgtccctctggagaaccctaatatagttatttatttatttatttgttgagacagagtctcgctctgtcacccaggctggagtgcagtggcgcaatctcggctcactgcaagctctgcctcccaggttcatgccattctcctgcctcagccttccgagtagctgggactacaggcacctgccaccacgcctggctaattttttcgtatttttagtagagatggggtttcatcatgttagccaggatggtctcgatctcctgaccttgtgatctgcccacctcagcctcccaaagtgctgggattacaggcgtgagccactactcctggcctacttacttatatttttgagacagggttttactctggtccaccatgtgggagtgcagtggcgtgatcatagctcactgcagcctccacctctccagttcaagcaatcctcccacctcagcctccctggtagctgggactactgatatgcaccacaacactcagctaattgtttgtatttttagacgagacaggattttgccatgttgctcaggctggtcttgaactcttggactcaagccttggcctcccaaaatgctgggatattacatgttactattgggccctaaactagtgctttatgcgaatcatcttttttaattctcacagccaccctaactggtaggtactattatcatccacatttttcagaggaggaaactgaggcacacaaaagttgaataacttactcaagcccaccagctcgtaaaagacacagctgggattagaactcaggtagaactgacccaaggattttctatttccttccagttgctgaaaaatcactaaactcatgaggcaatttcataagtctatatcttgtctgggttgctagtaattagcaatcattacatgaaatctgacatgtgaaagtgaaacacaattggaagacgttttgtgacatggatgtaaagtatatatttcttgagggtagagttgtttcactgccactgtgttctacatttaggcctttgctgaggttggaagtattcaaatagatagataaagtcacatcataatcccatgtatcaagtgtcatggaagagtacgcaatcaggcttttgatgaatcccacgtttcacttgcaatctgcagatttccatatgctgtggctcagcgatttgcactggcttctcaagcaaatcagtcatgactccaggcgtgactccagactgaaatcactcttgtcgatatacctgaaaacagaggtttccagcactggagagaagctttggtgcggggatgggctcagagggtcccgacagagggtgacacttgcatggttgcagaaggaagctcgctgcagtctgagtgtgtctccgtggagctcggcatttggacacagctcacacgcatgagtgatgctcttccacctgcatcttctggcacttgcactgtgggggccttcctcaaagccgtgcgcctccatctcagggcaacatagggcaacttctttcttctactcacattctgaatgaaatacattaataactggcttaaaagaatccaatcctttatcaaaagactccagcatttttccttccattgactgctacctgatattgaggaaggtataaggtgtcagattcctgctgggactggcagagaggggcagagggaggcaggacgggctgctggggtggagagtgcagacagaagcctgccatccgccggagtctgtgagcttcagggtccacacgagcctcatggagagacaggcggctgctccgtccatcttcgaacctggctggcatcgcagatgcccgtgcccagggcagcagccataaaggccgtggcaccttcttgcatctctaagtgtgtggcattgtggctgcctttgattgtttggcggtttgctgtgttctctgagtgtttttccacacatctgaagggcgattctttgtcaactgctactgtcttgctaaagaatcagcaattcacacatataataaagctcacaaccaaaaaaagcacattcacattttttttctttcatttttctgcctgagtacctctaccttggaaaacctccatcttgtcatatatgggcaagcattcatgtatttcaagtcatgtttttgcaggcagatgactgtgtaagtcctacatggccaccctgccagtgtttcaagcaggcctctatcatgtgctgacctatggctaggggtccctggtttctcccaccttcttcctgatggccaggcatacattcctgccctaagactggaaggctggcagaccagctcaggtcagctggttcaagaagggggaaagttttgctcatgtccaagagataacgtaagatgttcctgaagctaaacttctcttagacaggacacctgcagatggcacctttgctaaccttgattgtgccttgagatattcacctttccttcagagtgaatgctcctatcacctatatcacacttcatatgatgtaagatacaatttatatattcttgctcatttactcatttattcatttatagatttacccagcaaatactgatcaagtgctgagacatgctaggtgctgggctaggtgtggaatacaatggtaaacaagattgagaaagttcctgccctcagggagcttatagtcagtcatgggcaagtaaacaggtcattataacacagcagtgccctaagtgctattgctctatgtgtgggaaaacaggcaacctggggagccatggttaagagggacggagaaataacacgaatgtggtgaggcagggtggtatccccagagctgagaccttgcaatggctaggatgttgctagaagaaggaaatggaagcaagttccagagctcagaaaacattctgagatggaactagaagaacctggatgtgaagcgggagggccagggaggccacggagatggctgctggtttcaggtttgggccacaagtagatcaatgaagaaagaggaatccagaagttccagtccgagggtgtgtgggaggagggtgagtttcagagtcattaatgggccttttcttcagtaattcagaatactcctaagtgagtatggccacttggatacctggaaatattcatggctccaggtagctaccaagagaagacttcattttaattcttgtcaggaactgtgaaggatccaagattttgctttctttgcaagctaacaagttagtctgctcagttttacggaggccaggagaagaccagaggttcctgggtcagagacaaaggaccatgcattatttacagcaatatcttttttcctgtgctggtttctcaaatcccagttctcacagggtggtttgaaatggaccagatggcagctgcacatggcatgggttgcattacaggtgtgaggaccctgactttagggaatctgagtcttttataatgggccgtgagcaggactgccattgtcaacagagggagacattgtctttgttataagcaaacttcccctctgctgcggaaagagacagtatctctatcttccaaggctgttcactgtacgattattattgtaactatgttatgaaacacagggcattaatccatccatgagggtagagtccttaggacctaatcactgcctaaaggtcccacctcttaacactattacactgacaattgaagttcaacatgagttttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatccaagcactttggggggccgaggcgggtggatcacgaggtcaggagatcaagaccatcctggctaacacagtgaaaccctgtctctactaaaaatacaaaaaattagcccggcatagtggcgggcgcctgtagtcccagctactcgggaggctgaggcaggagaatggcgtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcggtggctcatgcctgtaatcccagcactttgggaggtcaaggcaggcggatcacctgaggtcagaagttcgagaccagcctggccaacgtggtgaaaccctgtctctactaaaactacaaaaaaaattagcacggcacagtggtgcatgcctgtaagcccagctactcaggaggttgagacaggagaattgcttgaacctggggggcggaggttgaaacgagtcgagatcactccactgcacttcagcctgggcaacagagcgagactctgtctcaaaaaaaaaaaaaagaaatattgactgctaaaatctacgttttcccatgtatttaatgtgagcaattatgattagctaatctcaatgcttatttgtagagtatatcattaactggaaagaaataaaccttgagccactgaagaaatggctttttctataaattaaatagtctttcaaacataacaaatgtttttaggaactacgaaatttttaaatttaatactagatcaaatcagcagataaacattttatgtggttccttttagatgtggtacacattatttaacaaggtagttaaaacctgttttattaaatcatatcataaaatgtttattcccagtgcaatcaatactcatattttatattataaagtgtttaatattttccacctcttattaacaacaaattaaaattgtttgctagctgctgagtcagaatattttcttttctttctttctttcttttcttttctttttctttttctttttttttgagatggagtcttgctccattgcccaggctggagtgcaatggcgcgatcttggctcactgcaacctccgcctcccgggttcaagagattctcctggctcagcctcccgagtagctgggattacaggcgcctgccaccacaccccgctaatttttgtatttttagtagagacagggtttcaccatattggccaggctggtctcaaactcctgacctcaggcaatccacacccgccttagcctcccaaagtgatgggattacaggcgtgagccactgcatccggcaataatattttctatctatagctatatctacgtttaagcttttcactttcttgacaatgtttgatcatgaataaagttatttctctttattacatgactcttacttaattattcacagatgccaaacactggggtgcattttaatgcatgcacacatgtgtacccaccaaaggactccaggctatccttgcttcataaataactgtaatttcagcaacacataatattcctttattacaaatcaagtacaagaacagatagatttattttagtttgttaaactttgtgaaatggttaaatgaatattctatgtcattctgatcctgactgtttttcataactcatcttgcaagatagatatctactttttagtgacccccaacaatattccttggaacacatgttagcatatttttacattaacaatattcacttcctctgattttttttttttttttttttttttgagacgaagtctcactcttgtcatccaggctggagtttaatggcgccatcttggctcactgcaacctctgcctcccgggttcaagcgattctcctgcctcagcctcccaagtagctgggattacaggcgcccgccatcaccatgcccagctaatttttttttttttttttttttgtatttttagtagagatggggtttcaccatgttggccaggctggtctctaactcctgacctccagcaatctgcccacctcggcctcccaaagtgctgggattacagacatgagccactgcacctagcctctgattttagctattggtgtgaagactgagtttgttaaatattttaccttttctataaattaaatgactcagcaacttccatttgggtaagaatatatttaaagcacatgacaaaaatattttatcaagagatgctttactggcaaaggcgtattgaaaataacaatatttaatattttttcaactctttctgaatgtattaaatgaagggtttctaaatgcacaaaataaaaggtacaattaatagttattcgtaagatcctcataaaacctttatggcatacttctaaaaaactgaaaaggtaaatcagcgtgccaataatttcatggcaaagggcaaaaaatacttttgcttctaattctttgttcctgaagattttgaaaaataaaaatatgttttgatgatagactatcatgtgattttggcatataactgcaaatgacttttaaaaaatagaatgatactgctaaaagacttcttccattgcaatgtacctatttatatgaacaaagttatttagtgcttacattaattaaaatgaaaaatggaagaaattcatattgagggctgtctgattccagctgtaagcagtatgcgtccgcggcatctcagtaagttggatgttcccattaccatttcactttttgtttaacaagtagtcaacaaaacttataatgtatttttgttgtttggattaactgtttactactaataattaattttaataactcaagtaggaaaaaatgttaacctcagaacctcgtttttaattctagaaattaaaaattaaaggctttgtacatattttcattacagaaatatatactggatgaccaataaaatattttcaaatataaacacatgttagagaataagagaagtgaaatggactactaggagtatgaggcccgatataaactccctttgataaagaagagcccattcatgtgtttacaaaatgaatgatgtggaccctctggtgtacagattctatttctgtcatttaaaagattgctgtctctcttcttttataaaatatttgtcagtattaggctgagcactgtggctgtcacctgtaatcccagcactttgggaggccgaggcaagcagatcacctgaggtcaggagttcaagacccgcctggccaacatgatgaaaccccatctctgctaaaaatacaaaaattagccaggcgtggtggcacacgtctgtaatcccagctactcgggaggctgagagaggagaattatctgaacccgggaggcagaggttgcagtgagttgagatcacgccattgcattccagcctgggtgacaagagcgaaactccattaaaaaaaaattgtcagtttttataacactccaggagtttcactttttgctactacttaagcctgggtaaaattttatgatggacttaaacacttgtgaggaggtacattgttttcaaaattttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttaaagttttctgtgtgcttttttcctctgccattatcccaggctaacgtctacggtgcagggtgagggagggtggcatctgcctgccggctgttggggaatttccctaagtttctgctttgcacccagactccgtcttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagcagggaaagaaagctctttgaaaagtttaacgcaatttgaaacatgaaaatcttcaaggtcctaaaattggggggcatgctgaaggaaattcagtatcatttctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagatctggtgagacagcatgggaagaaataacacatgggcttttgtgcagctggatataatgaaggtaaattgggtggaattcaaagatttgccagaaaaaagagagatgatttcactctaaaatcattttgcaagataatattttacaaggaaccttttggacatgcattataagcggttacattcccattgtcctaaaaaactccctgcatagttgtactctatttttatcaagccatgctctgacgcctcctgcctggttggcgataatccctaatgcaaagggatcgtgtgaaggtaagtgaagtcgttttgttaatgttgtttataaagaagcactgagcttctactttgtgcagagagctttacaaatattcatatgagctttatgaatatttacaaatattggcgcattaaaaaaataaaatgtgttcattttaaatataataatgtaggtgtcattgctatccccgttttaccattgcagaaatggaatttcagaggtgtcaggggccagctcaaggtcactgatgaatcaggacccgcttatccagctctctctgccttcagagctctcttgacttttctgcatcacttcctttaccaggaatgatatttaaattattccaaaatgtaaaatatagttagttttccaggcagttgtatttatttctggatttttttttccctaaataaaacctgtatctacatgaaaactcctccaggatttcctttcctcatgaagtgtgtggtttcctcaaggactgcctgggaggccctgaggccgacccactcctcccagcaatgacttggggaggagggagtgggggaagacagagagcaggggggtgggatgggagggcagagaggagggggagggatgggagggcagagaggagggggagggatgggagggcagagaggagggggagggatgggaggacagagaggagggggtgggatgggagggcagagatgaagaggcagaatgggagagcagagagcaggggaggaggatgggagagacagagagcagaggctgggatgggagggcagagaggagggggcgagatgggagggcagagagcagggggcaggatgggagggcagagagcagagggtgggatgggagggcagagaagagggggcaagatgtgagggcagagagcaggggagtggaatgggagggacagagagcaggggccgggatgggagggcagagaggaggaggcgggatgggagggcctgctgtgtgccctcatcaggtggatttcattcgctgggatggaagaggaggcatggcatagagacatgaagttctagaatgtttttggccactctctgcaaactcaagacttttttgggggggggtgggcggagagtgcaaataatgcctttttggagttgtaattgctccctgggagggttaaatttttaatgatttgtaatgtcctggtaggttcctgcattcatgaactgcttgggtgaatggctgtgatttggaagtgaggatgggagagaaagagagaaaggcatgatgggaacgtgggtcaaattgaaactcctgctctgacctcatcccttccgggggatgactcttattatcctggttggctacttgcaggcatgtctatacacaggccacctggattaagagccattcctcagggtctcctggctattgaaatgtctgtatctgtaagagtagctttcagtgtctgaaattggcctttcctctctctctatgtgttaggttccacctggtattcacttagggagaccggtcaccctctgcagctctgtctcactactgggtacagtgaagaggtttacaagcttggtagcagtgcctatgaaaataacaactaggatgcttctgttaccatcacagtcacccccattatccaagggggatacgttcccagaccctcagtgtatgctgaaatcacgggtagtaccgaccctatatatgctgttttttcctacacatacatgcctattacgaagcttaacttataaattaagcaaagtaagacattcacaacagtgctacagcagagcaggtataatggtgcgaggaccacgacacaagctacgtgaatgtggactcccgctctctctaaatatctcattgtcctgcgctcatccttcttcttgtgatctatagctctgctatcccagatggctactaagtgacttctgggcgcgtggtgtctacagcgtggagatgccagacaaagggaggatccacatccaggtgggagggtgtgagatttcatcgcacaactcagaacagtgagcaatttaaaacttaggaagtgttgagctggtattttccatttaatatcttcgggcctcggttgactgtgagtaccagagactgcaggaatcgaaaccatggataagcggggactcctgtatgcgctttggcagtgactggtggcgtggatgccacaaggcaggggagcctgggctaggctggttgctgtctggaaaaggggccccctttggctttttacacaggtatggccaagggatgtgacctcacctgagctgggacaggctgtgtataaaaaccaagcatcataattctgacatcgtatattaatgtgttcctgaaaggaatattaaataatgcctttctcaaagtagtaacattagtgtatctactaagctcacctaagcagggctagtctgtgacatgcagaaaataagcataacgtagtcaaaggcatattttgaaagtgaccattatgcaactattaaaataaataatacctttccccaaataggaacactagtatatctaccaaaggcaggttgctggtgactacttgattggtaaacatttgtttattcttcccttgtaattgacacagtaattatatgagcccacatctatcctcatccgtttaaatacagagctggtgtgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattctcctgcctcagcctcctgaggagctagaactacaggcacacaccaccacgcccagctattttttgtatttttagtagagatggggtttcaccatgttggccaagatggtctctgtctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaagggaagggaaaacagtacaattcggcgaaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttcttttagcagtttcagagtaggctatctcaagctgattgctacagactcaaattttaagtcgcatttctttcagaaacagaaggaaagtcaatctcactttcgaaaagagaaagtaaggtgacccttgtcatagtaacataatgcagcaggtcccaggtgtaacccggaggaaaaggcagacaaggtcctgcgatgccgcagctgaaaggaagctgacgccaacgggcttctcagaagaacaatgactcattagtcccgggctcacggcagatgcggtctcccaacaactggcctccctccaaaaacatggaggaaatcaagagggcagagccgggaaggaggctgcatccctcgcctgatggggagcactcctagcaggcacagggtaatcagaaaagtgctttggaatcacaaaatgaaaaaacaagtgtcagctgtgggagatgtagaaatgcaaataagtacgaatgcaaataggccggataaatggcagtgtgcaatcacccaaagctctgtttacaacccgaaggcagctccgtctgtaattatctgggcgccattaactgcgtgggagcagctctcaacgggtacaagagagataccaccagaagtgaaatgtcctctctcccgtgatgaagccagatctccgagcgattccatctacactgaactaaaccggtttgtgccaaagagctagaagtgtacctttggtgaaacaaggaagctagatttttttttattgcttactgcgcatctgaacgtaattcttgccattaattaagaaaacagatgataagagatttggcttcaataaacatgtactgaaagctaccacatcattgagtttaattatgcaagcaatctcgtggggcaggtactatgagctcagatagacttggtcaaggtcgtcccagtagagctgagattcgagcatcagtattttgggcctaggtttttttgttttttgttttgttttgttttttgttttttttttttgacggagtctcactctgccgcccaggctggagtgcagtggcgcgatctcggctcactgcaagctccacctcccgggttcatgctactctcctgcctcagcctcctgagtagctgggactacaggcgcccaccaccacgcccggctaattttttttggtatttttagtagagacggggtttcaccgtgttagccaggatgctctccatctcctgacctcgtgatccgcccgtctcggcctcccaaagtgctgggattacaggtgtgagacactgcgcctggcctggccctaagtttttacccttcccattatgtcagaagttctcagttgacaatgtctggagacatttttcactgtcacactacagagtgccactggtgtctagcagacagaggccagagactctgctaaacatcctacaatgcaaagaacagtccccctgacaaaggattatcccaccccaaatatcaagaatgctgacacggaggttgagaagcctggcatttccccattgctgcctctgggaggctgcctctcgggatagattgaattgttctgcaaagacatggtcggcagacacagagggttccctcaccaggggtctgggagttgctggaaatggataagaaaatcctagttctacctcgcagacagggaggaagtgaagaggtgaggcagtaaaaattcataacatatctatcacaaatgcattctgagattgcttggatctaaattgccctttccaaacccaagagatatttccaatgccacctgaaggtcctgagagctccctgacatcattcaggactgaaggtagaaagtagaatggccctgggttttctgagggttctttatttgtcttcgagaatattaaagaccagcatctctccagaatacaaataagagtctaatgtgataagaggctgaactgaaggtgtccctagaaaatttaagactaaaatgtcagctgaaagacaaagagaaagatgggattgttcttgcaaaatctcattggtaaagagagagaggattttcctaacaaaaatgttctgaactacaagcatctcagagggatttttgaattttggccagctaaacaccatcaggggttctggggggttagtcaaataaagtcagaaagggcctatctgcggcacaaaacacagcacagccaaagctgtggccaccgcaggaggagcaggagagaacctggtgaggagcaagaaagagcagctcagctctgcggagaagcatggtgctcagccatcactgctcgagcgtgaagagaagcgcagtccatggcagtttgggatgtggttggaagctctgcatcacagttcacatacttactaattttgttgatttgtgagctacagaaagagtctggggtcctgtccaggtgcggtggttcatgcctacaatcccagcactttgggaggccaaggcgggcggatcacttgaggtcaggagtttgaaaccagcctggccaacgtggtgaaaccccgtatctactaaaaatacaaaaatttgctgggcgtggtggcacgtgcctgtgatcccagctactcgggaggccaaggcaggagaatcacttgaacctgggaggtggaggttgcagtgagctgagatcatgccactgcactccagcctgggcaacagagcaagactctgtctcttaaaaaaaaaaaaaaaaaaaaaaaaaggatctgaggatctggggtcctgagagctccagttcttccccgcagttcccagagctgctcctgctgatacaggttctgctgccaaggcatcccaggggcctcagggtcccaggaagggccaaggctgcagctgccacctgcctgggggctcctcggccatccggcatcttccctccctccatccctggcctgctgttctgagtctctgagaagagcgtctggcggctggcaaaggggctaccatggaggaatggtcttcaggaagtggataaagctggccctgcctcatgccaatcagcccagcaagcagggaggacatcgccaatgagtttctggttttcacttcagaagttatagagacgatgtaagatgaaatactgttcagtgggctaatgcagccacacgagtgagttttattttcatccctactttaataaacatacatgtgccaagctggctctgaattatttaaaattacagcagtcagaagagagaccttctcaaagtctgtcagaaagatttttaatcatctttaagtaaacttcaatttctctgaaattgaaggagaattatttctccacttcaaaagtcagtacagagccattgaaggggctttccacctcctacgataagtaaaaacataaaatgattagcacaaaaaatacaccatgaaatgagtttaaagtccttaatcttgaaggctagatttaagacactattcttactgtccacaaacaggtttactttagtgatcataacaaatggcttttattcagaaccattactcagtatgattttaaaatctcgggcttcatcttttggataattcacatgaccttctccttagtgggcgagtacaagaaggcactgaatagcgtgccgttccgcaccaccaagcggaagggcagcactgcttgtatctaaggtggcgacctggaccaagggtggccttcgctgtcttggactggacgggctggactcccagctgaaggtggcttggaatttagctgttccttcggggccccgcttacacaccaacacccatgaatgcttttcaacgaagttgctagaatgcagccgtggagacgaacagcttaccgagagcctctgccaggaagcaaaagagaggttctcttccctttcattttggacatcgtaacaactaaacataacatttatatcactatctgtcagcagtttaacataaaccctctcacttactgccaatgtgtccacgctgctcctcaggcaagccattctccccagtgcacagatgaggaaatcggggctctgagaggttaactgacctgctcgaggtgaagaaaatgagtagggattagaatcagggagcgaggccgggcgcggtggctcatgcttgtaataccagcactttgggaggccaaggcgggtggatcacctgaggtcgggagttcgaggccagcctgaccaacatggaaaaaccccatctctactaaaaatacaaaattagctgggtgtggtggtggtgcatgcctgtaatcccagctacttgggaggctgaggcaggagaattgcttgaacctgggaggcagaggttgcagtgagccaagattataccactgcactccagcctgggtgacagagcaagactccgtctcaaaaaaaaaaaaaaaaaatcagggagtgaagttcctccaacacgcgtggtcttatactatgtcactgtgacttaccacatgccctgcatggggcgggggaactggcgtgcattgcctaaatcaagcgcaggagtttgatggtaccacgaagcgccacagggtgtgggagcctgagaggtactcacgcaatgcccgctggaagataagttcattgtcgcacagactttgtaacattgtaaggaaagaagcctgacagtagttttacaaatcacaccatataaattattaatggtaaatagataacccagagtggacagtacatactgcaatttataagaacaatcagtttttttaaatggtcataaccatttaaaaaaaaagaaaaaaagagaaagaaatcctccgcagtcattagttcagtcagttttacctttggtagaaacaagtgtgcttcagctgctaatattactcctgcctaaactgatgccccggtaggcagagccaaggggttaatggaaagagtggagcacgctgagcattttgccatcacagatgcctctctaaacgtctctagctcaagtaataacggagctgcctaattgcagtcattaaggagcctgtgactttaaatgacaaaggtagagatgctggcatcagcagcctgttagcatttaatttacatgaaattcgattcagtgtgcacgaactaactaggaggcgccaggcttaggccttaggcagacaaagagcaaaagtgtgggaggctgggtggggccggtgagctctggagcttctggctcctggactgggggactgggaatcggccaggccaggcccagcgggtgggagctgcagataccacttctccaggacccatcccagggcagcttcatgggatgggcctggctgagtgagcttcctaaggaaatcctcttgcctggaagaggctcccaatcatctgtcaacttgtctttcctatttagcaaacgattgagattctcttccttaaagacacattctctgatgaacagaatgtgctctgtaatgggtttagccaaagcatccccaccaccttcctccaggaatgtgtatgtctgtgtgaagtcctcaaggtcattagatctcatgaatttactccggcatttccatttccatgcatgctttttccatttagactaaactagcgcttggggtgcttgccatgctccaagaagtccctgcagcccctggttagtgggagacgcagagcaggcattcagtcagcaaatattaattgacgtggtgaggttgtgctctgaaaagctgagttcctcctgagaggctaattcactgtgctcagcctgtctgcgggtagcgagggctcctgagtaacagcgagctttgcacgagcgctaccgcgtggcggtggaaacatttgttccccttgatgaatgaaacggcactcttgacatgctgtacggacagaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttttgtttttttaatctctaggtaaccaacccctgcctacattttactctggattccaagagtagactgggcttcagggaccagatgccagggctggcacatctgcctaaaacccataattcttgaacttgacgtgctcagcctctccaaagccgcggcgctgacacagctccccctgcacgagtgtacagcagtcagacaggaacggggagagggggctcaactttctgacggccacttagaggctgcctgaccacaaagacaggactgtaaaacatagaccgcatgtgacctgctggtgctcggcactgacccaggggaggagggccacttgggctggaatgcagttgctgggggctcatgaggggctcagtggtgcccctggccaccgagtcaagcagcgtagattgatcagaggagctgagagctgaggcccaccctcccctttctcctacacatggacacctctgagtggaataagggaagactgtcctttctccaagcttgaaggaagatgactgtgactcttttcctggacttcaaggcatcgaagtgtcagctggctgccatcccagcgtctgacagggcagcaggagaaagaggccacctgtatcatccacccgtgctgcagctgaatgggatcggtgcagcatgatagaggccagctgccccgcaccaggtctgcgtgtcacagggcagagtgcatggtctcccttcacgtgcggggccaggtgactgcacagagtgatgagctgggcccactttcctgctattggccgccagcaaagaatacaaggggtttcccttcccttcccttcccttcccttcccttcccttccctatcgacagccttgcagggtggtggtttcctttgcccggagagttcagaggccttagttctggaaagcctcctgtggggagatggagtggcggggatagggaccagagcagagagggcagcagcataaacaaagaggagaggcaaactgtttgagcccaggagtttgagaccagcctgggcaacatggtgaaaccctgtctctataaaaaatataaaacttagctgggtgtggtggcacatgcctatggtcccaggtatctggagcatggggtggtggtggggtggtgggaggatcatctgagcctggggaggtcgaggccacagtaagctaggattgtatcactgcactccagccttggcaacagagagagatcttatctcagaacaaaacaaaaaaattggagaagggatttctctgatttctccctttgggaagggaggcttggaggctgcctggggctgagcagggagcaccatgcttgtaggcctttggggaggtttcgaggtccaagtgtgacttagaggaactgggagatgccagcagacactgagacccaaaggggcctggcttgggacctatgcagctgtgggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagctctgcacaaacgaaacaattcatcctcatctaatttataaccatcctcccacactaggaatatggagccaggaatgagggaggttcacgtgggaggtggcaactgcagaacagacagctctttggatttctttaaattgccatttaattccatccatcaacccatttttctgctgtatacatagaaaaggacaacagccactccctcaaccaaatatccctacattcagttaaaagctactctgtaccccaggacatgggagcagctcctatccttcccaggtgaaaaagtgggctttttttcccccttaaggctaaataggatttcttttctgttagctatgggtaggtgacttcttaatgatctttaaggaaagaagtcaatacaaggaaaatatccttttttaatcccattttccttctcaccccacactgagcgttactatagcaacatctttcctgctactaggacagttaagtccccctgtgaagttaaccgaaagctgctttttcactcagagaatgggctgctgttcattgaccagcttttcctgcgtgtctaaattcttcggttctctctgacatgctcaatctagggtttcccgcggctaaaccctaaaattcacttcgaaactcctaacagcagaattccccaaaccttttcagaactgaactcattagaaatgaatttacattttgatttagttataaataacttttcttctgtgtattggtttaagtttagaaaaggccccctgtaaagaagacaagttggagaataatctcccatattcctctgccatcctttctttccttcctttccttgagatggagtctctctctgtcgcccaggctggagtgcagtggagtgatctcagctcactgcaacctccgcctcccgggttcaagcgatgctcctgcctcagcctcccgagtagctgggactacaggcatgcaccaccatgcctggctaattttttgtatttttagtagacacagcgtttcaccgtgtaagctaggatggtctcgatctcctgacctcatgatcagcccgcctcggcctcccaatgtgctgggattacaggtatgagccaccgtggctggcctcctttttcttttaaacacatacatacatatatgtaaaaacaaaagaaaatttcaggaccttccaaatttcacaggcctagaggaaagttaagccctggaaatggagttgtgagagcaggctgttttttctctctggtgcgtgaccactgcttcctgatttttgtgttgagatcttagaccttaaccagacttatagccttcattcaaaccagactgaatgatgtgggaggtagggaccttggtcattgttatctctttataataaaatgctaagcaacccccttagagtgaagtcaacagtagccaatcaaatcttacatctgtgtgttagccgttgtatggaaaacaccgtgattctgttcagcgcctcccttttgcctccataaaagatcttcacttttccccacaccgtaatatttcactggattcttggaatatcagaaattcatcattctttggtgtctgcgtatctctgaatggccactcccatgcagcccttgaatgaattacttaactggatcctaagcattttgattattttagatggacatatacacatgcatatacacgtatgtgtacatacacatatgtaatgaaattgttccaaaacacagaaaatacaaagactaatgtaatcaggactcacatatccacatcttagatttaatgctgatttcggggggcatttttgcttcaaatttgtaaaaagcaaaggttacagacataaagatcttgcgattctcttatcccagtttcttccgtctttcttctcttctttctctttctctgtcccccgaggtagcatctatgctgacgttcccgtatatcttttccatccaaatatttgcatttttgctacacattacgtgcaaggcttttatctgcttcctcctaatttgtgggggcaagaggctagacatctctggctggaaaggcactccctgcagatctgggaagccatgagccacaggagcattagctgttcctctaccctttcgtttctttgctggacaatccttataagctggagtccaagttaaccttcccaaatgagtggcactattattttaaaataaaagcgttcaaggtagaggatgactttgggactctggcaacacaggaagcccagtgtgttctccccaaggtcacattaaaaaggtggtgcatctgagatggtgactgctcagaataaagtgataaggggacaaaaggtggatggcttacttacaggtgttatgaatgagaccatcagggctcgggtaagaacattgtctgggataaatggtttgtggttattgatctggaccaacctgatagaaaagaagctgtgtgtattattattacaatttcttggtttatgcttgcaatttataatttgtatgctcagtcaattctgccaatataaaatagtaatgccccggtttcaaaatctgatattggattttgtcccacgatttagcatgtcctctaagcaaaataactgtccaaccagatcacttgccttcaacaacttaaaacacaagtaactagggagaaaaacaaacaaagaaacataaactcaaagaaggtttcaagattgacatagagaaaaatcttttctcatctatccgtatgtactctcccactgctcatcgtgggccccagggaaaggcgattttattcaaagaaggtaactctgaacgtactcagggccgtaatatgtgaaatgtctcccagtgtttgacaaaaagactctcttttcatgttcatattccatggaaatcttaagtcaaagcaacaataaaataagctgacccataagtgcacgtgttgaagaggctcagccaagaaaaactgtttggtagttgctgaaaactggcatctagacctcaaagaggaaatcagaaccaaagtgcagacttgtcccaccagagatggtgggtgttggactgagtcagcgacagtgaggcactgactagacttccgtaaccagccatactttctagtttataatgacattcatggttattgttctacacagacaggtgtagggaagcaatgggaaagtgcaggaaaacagaagcattgggaatggaacatctttggtttctccatttcaatgcactgccatgacccccacacccacccacgagactttagctgttccagagccaacggtgcctgcctctttgctgatccattactcattctccctacagctgcctcatagctttggctcccaagaggtaaggtacaggtagtctggctgcctgcattatcctccagcctcaaaatacatggggaactgaaaataaacaaactgttgattccttgagcttaagaaggcctcttggtgttcctttataccttttcgagtctctcctaagatcagagagaggagtgaagagggggaaggtgtatggccaaaggaggacttgccctgattgccactggcaaagacgctgagccttagggaccatccagaggcatgcaggacccctgctgcagcattcttgaaaaatgatgtcttcctacgcctccctgactcaaccagaagctcacaggtaagaacacatcccatgttgcgaagctccatctattgtgagaacttctgccctgccggctgcctctgacatgccacatgcaagtgataccatttaccctactttgcaatacataacaatctgcactggtgtttccaatgcccaattgttttcttgacttctccataagtttcagcatatctataaaccactcataccatgatttacttaatgttttctttttcttccttttttttttgagacggagtctcgctctgtcacccaggctggagtgcagtggtgtgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgacctcctgacctcgtgatctgcccaccctggcctcccaaagtgctgggattacaggcgtgagccaccatgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttatttctcttaggtcccagcaccgcagaaaatcatcttgaacacctcccaaggccaatctcccattgcaacaaatgaactattaaaaacaggggtctcttttatcctaccgtcatctcatttccagataaaacacctccagtttcttcaatgacttccacgagaagacctctctggagaggtctgaacattgtcttctgtcagctccctcttgattttgggaccaagcattgaatataaagttaggatgtggcctgattagcataggcagagtactgagaagccttccttgtgcctgtcactacacttccatcaacagactccatcaacaggaggcaacgcagcctcaggataccacctgcccacggcccacctgagggaacctgctgcccacagcctctgctcccagagggacctacccagtcccaaagctgaggcaccacccatccttgaatggccagagtaacctgtctcaagaatatgagcaagatgattccaagagaaagtggcagtcaacagtggttttgtacaatgcggataaatattagaaaggccatccaggatgcgtcatttgcaagcttgggtggacaggcagctgccaacagtgacagcaggtggcccatgagtgaaacttagagaattaggggactgctttggtcttggcagatttcctggccagtccatggaaccctcaaaataggtcccttaattttgtagaaaaatggtgtcacctttaaacgttgtaaactacatttataaatttaagacattcttttttttcttttttcttttcttttcttttacttttttcttttcttttcttttctttttttgggatggagtctcactctgttgcccagactggagtgcagtggcatgatcttggctcactgcaccctccccctcccgggttcaagcgattctccttcctcagcctcctgagtagctgggattacaggcgcaccaccacacccagctaatttttgtatttttagtagagatggtctttcaccgtattggctaggctggtgtcgaagtcctgatctcaagtgatcccacctcggcctcccaaaatgctgagattacaggcatgagccactgcgcccggccttaacacactcttaagtacttccaaagtctgatttaaaaaatagttttgtttttcctgaggacttaaataacttataaataaatcaaagcaatagatatagtgcgccttaagttctctgaaaggctttgatactgtttacaaactttgtcagagttcaatttaatatccctagcctcagtcaattactcaattgtgtttcaagctaagtcacaaggctgagctgtttcactaattaaccacattcctttagaagttcaagtatgtataaattccttaatacaaaatattggttctgtgttttttaattctttaaaacatttctctacttaattctaaatcttttagggtgaaagatgattagctactaaggaaactattgcaccatcccacacaactattttaggtgatgttcctgtattatttttgggattgtcctctcaatttgcttgtagttgcgttataatcaaaacgtttagctggggtgctgactagattcttcatggtgaccaagtgggttccatggagccctatttatagttgccatagtgatgattccataacccacaggcgaggggcagggagcccttgactttaaatccaaattctctctctctctctctctaatatcatatatattttatatatatataaaatacctccattcaagtcacttggcagaattttgcactattgtgctcttaagatataaatatatttccatctcaaggtcacgtcaggcttaataaaattctgtattgtcaaagtctatacaggaccacacacattcttcgtgtattcaatcgcatttttgatatctctcatagccatttttgatagttgcaaattctaaggccattcattcccacaatctatttgatgaaagtttttaaaaaatggaatattcaatcctttatagccaatgagggcctgagccttgaaccagtgaacagtactgagtagcagttaggagggcggggagtcagactgcctgggcttaacgtcgtggctctgtcactcatttcgtactcttaatcatcatgctatagaaactcccacaatgtgtgtgtgtgcatgtgttattaaatccttcagatacttctcagactcttgcctgtgtagataaacaacgtgtgttttctatcaccttggcttgtctctagtacctggttttttaaccaaacattactctgggtgttgtggtgaaggtatgttgtagatggggttaaaatctacaatcagtgggattgcccttgataatcttaacgggcctcatccatttagttgaaaggccttaacaggtttctcagaggaagaaattctgtttcaagattacaacatcagctcctgctccgttcccaaccttctggcccgccctgtaggattcagacttgggggcctccatggctatgtaagtcaattctttgaaataaagagaactccaactaatgcacaacggtcggtccatccctccctccctccctccctcccttccttcctcccttccttcctttcctcctcccctcccctcccctccccttcccctctccccaaattcaaaaaaagttaactttatgattaccctttctgggaatactagttgttactatacacattattcacatagaaaaatcagtaatgtaccagttggtagttgaattcttcagagggaaagattagtatcttattttttatttaatgagatgaggaactaaaagagcattactattctttactacaatatataacagaagtgttttcttggtgtctgcaatgcaaattctgatgtcagtaaatacattgagagactaatttgtcaagcaagcacagaccacacatggtttctttttatttctttctttctgagatggaaggaaacctaaaagtaacaatgtacacaactcgctagggttgccagcagcattttggcgatgtccccttgggtcacagaacggcagcatgggttctataggtcggggtggcattagcactgacggcacatagcctgtgtcttttgagctcactttccatgttatcctaggtcctgtgaaagaaagacctcaggctcacgttattagatccttgggtaattctccatactctgaagttcttgaagaaggcactggctggggttagggtggctttgggaaacccttgactgcttgaggaatcctttccaattccttccttaaccaggcaggaggaacagcagttcattcgtggtcttgagtccaggttccaggttctaagcttggtctatgcttttggtgtgctctctaactcaatgataatgatagtcatggaagtttcttaatatctggggttttgaaactgttagttcttggagcaagcccaagtttattttgggggaactttgcgccagcattgtagttatactgaaatttagaatatgtgggttgaaaagcaccaaagccagtgtgagaaatccagcccaccattagggctactgaagtcccattaggttgactactttctggaggccaattgcacttaacttggattcctgagtgactttctctggtccataacttcatctaggtcactgctgagacatcacctctccagtaaaaccatctagcctgtctaaagtcatccttccactcccccagttgtctcagtttctctgtcttttcttccccagctatatttttcttcataacactggtttctctagacattatattacatctagatttgtcatatcctgtctctcctattagaacatagacttcttgagacgatggactgtcagtttggtttaatttgacacgtgttttttttttttttgagatggagtctcactctgtcgcccaggctggagtgcagtggtatgatctcggctcactgcaacctctgccccccgggttcaagcaatgctcctgcctcagcctcctgagtagctggaattacaggcgcctgccaccatgcccgactaatttttgtatttttagtagagacggagtttcacaatcttggccaggctggtcttgaactcctgaccttgtgatccacctgcctcggcctcctaaagtgctgggattacagatgtgagccaccacgcccggcctgacacgctgtgttctaaacacccagcacaatggccagcatgcagaaaacactgcagaaatatttgctgcatgaatgacttgctatttacatcagcctactaaatgctacccagtgagtagaaaaatttcaaatgaaagcatcctaatcattcctttttttatagaggcctatcagtgtaggctattctagtggaggaaatcacatccggtccctggtgccatgaagttacagaaatattaggtgcaggccaggtgcaggggctcacgcctgtaatcccagcactttgggaggctgacgcgggcagatcacaaggtcaggagaccgagaccatcttggccaacatggtgaaaccccatctctactaaatacaaaaaattagccaggtatggtggcacatgtctgtaatcccagctacttgggaggctgaggcaagggaatctctcgaacccgggaggcggaggttgtggtgagctgagatcgcgccactgcactccagcctggcgacacagcaagactccgtctcaaaaaaaaaaaaaaaaaaattaggtgcatacaaataaatacatatacacatactttaactcatatcaacatattatagagaaacaaatattgaaaagaatttcaaggctggccatgtgtgtttatagtttcttccagttcaaaatcactatgaaaaaatgttttcctaaggagaacgttggcctctaggggaagcaaagggctcctgtgttgtgatggttaatattgagtgtcaacttgattggattgaaggacgcaaagtattgttcctgggtgtgtctgtgagggtgttgccaaaggagattaacatttgagtcagtgggactgggagaggcagacccaccctcagtcaggatgggcgaaattgaatcggctgccagtgcagctaagataaaagcaggcagaagggtgtggaaggcctagactggctgagtcttccggctttcaaatttctctcgcattgaaagcttcctgccctggaacatcagactccaagttcttcagcttttggactcttggacctacaccagtggtttgccaggggctctcaggcctttggccacagactgaaggctgcactgtcggcttccctacttttgaggttttgggagtcagaccggcttccttgctcctcagcttgcagacagtctattgtgggacttctccttgtgatcgtgtgagtcaattctccttaataaatgccccttcatatattcatctatccaattagttctgtccctctagagaaccctgactaataatctcccacatcaccagcttgaatcctgcccaagaataaagaggatcaaggacagggcactgaactgtaccaaaagaaagctgctctttgggtttgcgaatgctgacctgggtctgctttgtatgggtggtcagagggtgaaagggtctggggtacatgcacatgacccttcctcttcctcttccacccacatgcccagagagctcagggcttcctcaggagaagagatggtctcattgctcagggaaccttttctcctaggcaaacagaggtagtgtggcagctggaagaggcctggagtggtacttggactttgaagccaaacacttgccctctcagagcctttgcctccactgtggtcctaccagagagctgagttcaggacctgggtttgggcgtggaagggcggtgtgagagcaaggctgaatagtccaacttcctcctttaacaaatatccactgagcgtcttcgctacgcaaggctctcttccagaccgcttggttctttggagtccaggagttctccactcggtacacccagttttaccaaagttaaacccatgagattttgtaataaagccaaggctaataataatgcattccattacttttcctacacatgtgtctctgttaagcactttgcaaggaggatgggcagctgggccaatgcaggatccaactattcaagattcctccacttacacaatatattgacactaactctgaatgcatccctactgaatagagaactctagtaatttctactgaaaacatcaaataaaaaagctactactttaatagaaattacctcttctaattgccctacaatgatacaactgtattctgaaaggatacatggatgtcatataaataactcaaaattcatgtttatatttatgtacagtgcctagaacaatgataagacatgactgctgaatgtgtggatagatggatgggaggatgaatggatgcatgaatgaattaatgaatgctctgtgatctgagggctgaagatacattactgaaaactccaagaaggtcagaaagcaaaatcaaggaatatgaaaatctactgttaggtacaaacgtgtctctagagaagagactggttctgaaaatagggagaatgggaaccaccaacttcctgtgtgtgtgttaccacactcttaatatgaaaacatgtgtgataagaagtccaacattttgtagatgaccgcacatgtaagttaaagaaatagtggccttcttttgtctttcctttgtagttttttgggaaaaggacgccaataatcaaaagacctgcagaaaaggtgatttggtgtttcaagggttgtgggcttttatgggacacaagctgaactgtcatgcagacaatgaccgccttctgatttacttgggctgctcaaaactctggaaagaaaaatagaatatcctagctgttatgggaatacttataagaagaaaaagagaaatacagctctttgtacattcagattcctttagcttgaaagaaaaagggtagcctcctttaagaaaacctttgggtttgacagaacataaataaatcttagtgcagctgcttatcgagctaaagaaggcctggtgtctctgctgccacttacagatttcagaaacgtgttgtcattctttaatcatgatcattattggagaatatgattgaaattttaattattaagtagggggaattgtgaagcactttcatccagcatctcgggtgcctggtgtgatcgaccataagtgcagctgatgcaaacctggaagccgttatcacagctccctggccctcgccgcggtggaggcagccgtctgtctacctcctgccggctgcctgtctcctaaaatgtctgcatgctgtttactgcagagccagtgtttgaaccaaatgctcagtaatgtgaaaacatcaattatttccttcctacatttaaatgaactatgattacccttgatttaatagcaaaggagcatttccaaggtacaaaaacatttcagccattaagctcaaagtttgtgtttaaaatatatgtttgttttcttctacagagcaatgggcactaaatttattagcttcgtgctcaccatgacagtaactccatgtctgtggaattctgtagtctgcatgtgttaggctgtgggtaggcaagcttgtcaatggagaaatactgactttgccagaaattcgtaaatttttaggaaagtgaagagcatatggtcactatgacttgctagtatccttggtctaaaccttataattaccagaagccattttcatgtttttttttttctttttaaagtgcatatctttatttggacagcctcaaatcccttcatcttatctggagggaagacaggaatgaaaaccatgatagtatccaggagggattttaaggcaaggctgagctttctaaagctacaagcacttccttcctcagagagtgtctgctgacagccagggccttgttagtggcccagtagccaaaagaagctactttcagaagtggtacttagcacctgccctcagtgatcaccatttttcaggtaagacttgttctccaggttaattacagtggaaacctgatcgaacttgacagtcagtgtgtttgtgggcttctcttcctgccagtctgcaacctaaaggaaatgctgtggtctctctcttaagaatgagaacattctcagaaatgcccttgaagtgactattaattccagaatatggtgtgaattaagtaattcatttggttttagtttacttttgagaaagtccaagctgtgcacatgttgaaataaatcagaggcctgtttacaaatggagccaccatttcttagtgtggagtgcagggacctggttctgagcaaagtagtgggaaggatggaattccctgaatccctggatctgttcacaggaatgcctagagcttctggcacacagggtagcaggccttcctgatgccccagcttctctgagatccatcctgctgtcagccctagaactccctcacaagcaagctattttcccgtttttctcatcgctgtttagaggtttccacttatatgtagatttgtccagggtcctaggaaactagctaactggtgccaccataacatttgctataattataacagttcagttatttggttttctctttgtctccttcttcataatttagaggctttcaatgacttacccctaatgggagatttctggcccagaaatgggtcagcagaaactattatattgaaagttggtttcttggtgctgcttacattattttatttagataagaaaatggctgttgatattttgtaaaaaaaaaaatctatttatccatcaaatcacatatgcttctttcctttaattcaactatccatccatcagtccatccatccatccattcatccaaccattcaacttttaatgtgtccccacagggtgaagcaggcatggtgcaggaatagtacgaacaaatataaacagcaattgatcctaccctcaataagtcatctgcttagaggacagattttggtggtaatacaaccaaagtttataataggaatataatccgtgttattttaggatgtcacagaggttgcaacaaaagattattttatttaattcttgttgatgggcaccgtgtgtttacagaggagagtgcctttgaccaagatcttgaaaagtgggttagatattgcttgggaataatgggcaaaggaggtgccatactccctctggatagtctcaggcccaaatatccatttaggatctctggaatataatgggctatacttggcattggagtcatttagaaggacacaggacaagaagcagcatatcagcaggaagggccaggggacacttctctgaacccccgtgatcacttgggtttggggaaggagacatgctggtaggtaaggagcaatgctggggtagaagccccaggtgccacatgtgctggcaggagttccgggggcacaaggccaagctgaagaagacacaacttcatcgccgtgagcatgacttccagggatgtccacagctgtggcttctcccaggtatttatagttcatttacagtcctgcctgtcaagatcccacacaccaaccaagagttatcttttttttttttttcttcagatggagtctcgttctgtcgccaggctggagtgcagtgtcacaatctcggcccactgcaatctcagactccctggttcaagcaattctcctgcctcggcctcccaagtagctgggactacaggtacgcaccaccacgcccagctaatttttctttcttttttttttttagcagagacggggtttcaccatgttggccaggatggtcttgatcacctgacctcatgatctgcctgccttggcttcccaaagtactgggactacaggtgtgagccaccatgcccggtccaagagtcatctttatcataagtacttactgtctattaaccccataaacattccacctgcatcagtttttcagaaaacagaactgaacgtcaagtttgtcctcagggacagagaaagagttttgctagccagtggctcagaggaagcagcggcctgtgcaaaggtctggaggtctgaaaagtactcagtgagttccggacccggaaatggttcaacatgagttaagtataaggtgtcgctggagatgagggggatggtggagagggagggtaggtggaagatgaggccagagggtccagaaaacaaagtagatggtcttaaggagctgaggtttttaagctctagggaatcactttatggggggtgttatgagcatattttatggtatggggataaaggatggattactagggggaatacactcaaggcaggaagagtgtaggttgttccagtagttgaggtaaagagtggggaccctgagttaataggaaagaggaggtggatgcaggaatcactggccttctggaatcaatcagttatcagtcagccactggagataaaagggtctggaatacatgcacggaggattctaagtgccactcattgcaaggaccgaggtaagaagagacaggacagggttgcatgtgggtgagggaagaggtggaaaaatgagctcaaatattgacattttacatttgaaatgcttatgaaaattccaaatggaggtatccagtaggcaatgtgaagtataatccaggagctctagagaatggtctagttagagacacagacttggggcctatcaactataggcagtcagaactgcagaaatacacgagaaggtctgagggagggcttggcttgaagagaggaccaaggatggtcaccttgaaaataacagcggttaaagggcaggtggaagactagcttgcaatgtgggctgtgaaggatggcaatggtgggggaagatggctggaaaggtgggtgagaagggcacccacaagctagcaggggagggaacagtcaacagtgccaaatgccgccacctgcaatgagcggggactcactacggtagggacctacacatgctttgtctcatccttttcatctttgcacaatattagcctctactgtcttccaatatgaccaaagtctagtccatctagagagatcagatcaaaagtgagcctgaatcatttacatctaacaatgttatctagacagcatgcttttattctgaatcacctgaacttccagctatctgtggtttataagctggcataagctggcatttttcagtcgaaataccacagggagaggtattttaggagctgatttggtattcagttaatactgtagaacgtgctcttccattaccttgaagctaatgactagctaaattagttatatggcccaaagcaaagataagatggttagtatgtttgaccagtcattaaaatgtgtgtctttctggaaaaatattctctgaagtgaaatgacaccatgatgtctgatcagcaatatagctcacccttattttaaaaggtctactttgaatgtctccccagggtgatcatattaaaaaaatcaaaatttaatatgtcattaacagaggttaacttgctgaaaaataagctgaattcgttgggaattgctgctaaaacattctgtagctggaaaatatcaccctgtttctctggagaacggtagcaataaaaacacacagaatacactttcatcccaaaattggcatactttaaataatccatgatttttttgttctaaactggcttaataggtctgaggccaataatattttctatttcctcaggatttcttcactcagtttttttgtttggtagagcacttagtattaacaaggcactacagtaggctataggggcatgaagatgtcagaagttctatgtatagtagactgcaatgtactggaagcaacaggaaagtcagagagataaatacttacataaatactaaatagagaaaaaactacctaatgagaattatgggtgactgagcaccaaggggttccaaggtcagtgtgagcccttctggctggagtggtcagtgatatattattgaagaaggtggcatggggcaccagtagaattcctgaggcatccagattcagcacggcctctggaaggtgactgccaggtcagcttcactgtcagctggtgcctctcctgacccctcctcccttgttaccaaggatgccaaaactttcccagctttcagaatgacgactgtttggttctacctggcttatccttactgatcctgcctaactggctcttgaatcatgttttccagaggtcaactgagtctaagaagacattaaaaatcctgaaattggccatatcatcctgcccctccttgattttggacaggatgcatttgggatctggcagcacttttctgagggcatcaactaccaaggttggagggatctttacatcaacctacactatacctaccagatgctttctttgaccatcttgatatccagatatggagtattcccatttcttggttcccatggactgaaactttacaggtaaaggccaaagttttgattcagcatgaatgagaaattcaatgtactataagctggaaagacttggctgaaactcagccccagctaaagcaacatcagaactgcatacacagtggtaaagatcaagtgtccactttggaagtataatctttatctagtgatcacttttccaacatttccatccaaattttggaagcacctaaatccaagccctgcaactatcccacaatattatagtattattcacttatatttaagatactgtactccatagagctaggatggtagacatcaacatacagagacctttagggttttttttgtttttgtttttgtttttgtttttttgagaaggagtttcgctcttgttgcccaggctgaagtgcaatggtgtgatcttggctcagagttttgctcttgttgcccaggctggagtgcaatggtgcaatcttggcttaccacaacatccgcctcctgggttcaagagattctcctgtctcagcctccttagtagctgggattacaggcatgtaccaccacgtccagctaattttgtatttttagtagagacagggtttctccatgttggtcaggctggtcttatactcccgacctcaggtaatctgcctacctcagcctcccaaagtgctggaattacaggcgtgggccaccatgcccagctggtactttctcaagccagggattggattgggaaaactgatggagttggccaattcctatggaagtcacatttcattcctggaaactttgaatctcagattttcttttttaaagaaacttcatctatatatcatttatataatatgaaatatgtcagttttaattgtatactttgatgagttttggcaatatatgcaccactacaatcaggatgtattttataacctttccatgttctgaaaaaggttttctcacgcccatctgcagtcaacaccatcctatgcccacctagcctaaggaaatcattgaacttctttgtgtaactacagtcttggtattggtaatttctcagaaagtgtaaactcatgttcattagcagacaaatagaaaaatgaattaccaaataattaaataatgccttgaagggctccaaagtaagtcacacctcaaattctgacatacaggcccctaaggtctcttatgaatccccagtgaaacgaattagtcaaatgtcaggtaaaaccatcaggcaatacacaagttcctccaccttggcttccccacctgttgcttgctgggtcacttgctcccctttgcttagccagttcgacccacaaaatatctccttggaagccttagctcttcaaggaggtgacaactgcttctgcagagctcaggtccttgtggtcaacaaaagcgataggctgcgatcctctccaggtgagctgcagaggttagaaagcccttcaatcactgactcttgcagcttggagtatgcaaaaagtcgcagcgacagagacagcagtctagacggtgagtcttctttcataccgtcgagactggcccatgcaggacctgctttaggcctttctgcctcagtgtttgcttactgctctagttctttttgaaaggcgacatgctttctggcttgcttcttttggtaataatgatgacttcttaacattgggattttaaaaaatcatcttggagctgacctacatttttatacgttctgatgttcctcattccttcgtacagatctgggcttcacttcatatcctttcaacctgcagacgtgattttagtatttcatgcagtacaagtctgatggattctgtcagcttttgtcatctgaaaatgttatttttgggggcctttcttttggggatttttttttttttactagacatggaattttagtatacttttttctttccatatcattccattgttttctggcttccattgtttttgatggagaagtcagccctcactcttatcaccgtgctctccatacaatgaggttccctctggcagctcttaacattatctccttatcttgtgttttcagcattttgactgcaatttgttttaacacattgttttctttgtaccgctactgcttaagattcactgtgctttttgggtatttaatttgatgttttccatcagttttggaaaagttttcaccattatcttttcaaatatttcttctggcccattctctttctttttcttcttggattccaattacacagtgtttgatattcaccagatcttggatactctggtctatgtttattactttttttcactttgtgtttcctttctctccagctttattaggtataattgataaataataatcatatattcaacacatacaaaataatgacttgatatctgtatacactatgtaataattacaatcaaattaatcaacacttctatcaccacacatagttatctttgtgtgtgtgtgtgtgtgtgtctgtgtggggaggacacttaagacctagtcttagcacatttcaagtacacaatacaacattattaactctagtcaccatgctgtacattagatccccctgtgtttctatttgaacagtttatattgaccgctcttcaagatcattgatacttacctcttctgctcagtcttctgttaacctgttgaatgatttagtcaattctgataacattctcttccaggaaagtcttattacttttagtaattttcttcacttaggttttttttgatctcagctctctgatgggttaaaaaatctctgaaactatgtaagctgtttggcttgttctttttgttacggtagaaatctagaaaatagttttatcatttctcctccagtcaactagtttctatttttgcactcatctgctctgatctgtttaggcagaagcttaaacaattctgcttgctcaactaactcagacactgtggatgttaggatgaaggtacagtttgcatattaaaagataagccagtacatctctgagatttgccatcctctctggtaaggactgcactcaaagtaacaggagggcctaaccttaaataaatatgcagccatactgctagggcaaacatccacacacagacacacagacatacaaacaacccaaggacaggctttctgacaagtgattgatagatttatttcaaagctgtcaagtagagcccaaaaagagtggaatctcagggttctcttggcaagactatggttctcagatgggcatacaagctttttcctttctgggacagtcacacgaagttagttaatgagggatttttattcttttgtttctggtggcagaaataaaatattcttttcagggcaaaggaatgaaatctcatcaagaggttcctgtctagattcgcgtccttatatacaagccaacttctctctgcagaatgttctacatcccagaaaccaggattgtttgccactgatttcattttcttctcactgttgcctctggattaaaaagcctctctcattactgctcatcagtgtcctgctgctgggggagccatttgtgctgacgaatagttgtttttttcaatgtactgggaaagtggcattttgagagagacttcttccatctacacccttctgtcttaagtataattcactcattcattcattcattcacccattcatcagtaaatattattgagagtggactgtgtgcctggcactgtgcggtgaatttgatatagacacatataatacgaacacgattctagccctatggagtatatacgttattaactgataagttcagtccagcacacacttaccaagttcttgtatgtgctgggcatttaagagtgtaatgacgagtaagatgggcatttctctgtaagcatatggtccaatggggaagacctagatacaattttaatacaatgctttactgttgtataacagagaaacatgcagattgctatgggaatgcaggttgagaggtgctgagcctaaaaggaggatacagggaaggcttcctggagatgatgacgcttgagaggagtctcaaaggatgtgcaggagcgacagaggctgcaaatgcctgcccaatattcatgttcctcttcttcctcagtaacagaacaccaactatgtgcccagcaaaattctacttttccagccttgcttgcattagggctgatcagtgagctgtgagtagagggtttcctggggattccagggagctacattctcaggaggaatggccatggctcccttgtgaccatggaggtcccacactgtccgtcagttgcatacttccagcttttttttttcatgtgagaaagagtaaaattctattccttctcactcccttagcctacactttatttttatttttagttttattgagacagagtttcactctttcaaccaggctggagtgaagtggtgtgatctcagctcactgcaacctctgccttccgggttcaagcaattttcctgcctcagcctcctgagtagctgggattataggcacgcaccaccacacctagctaatttttgtatttttagtagagacggggtttcgccatgttggccaggctggtcttgaactcctgacctcaggtgatccgcccgcctcaacctcccaacgtgctaggattacaggcatgagccgccatgcccagcctcttaccctatactttaaaacaaaaacaaaaaaaaaacagccaaacctaatcttcaatctgaaatagtgtactacgccaggtgtagacaggaagagagaagaggcagtgggtctgggaaaatactcagccttgaaaagtcaaccataataaatgtcaaatcctacagagtatcctttaaatggcaagggggtacttcagcctgactccatttttgcctcactccccatttattgacatgtgcttattaacatgtttagaaacttaaaaatgcattcatcctttactgaaatctgcccaatgtcgtctgctattatttcaaatactcatatttcaggaaggctcagatttaagtgaaggtgtcaccacagtctaagttaccatctcctgtccttgcatccatggccggggaattactctgctatttaccactaatgcagctgccgggaggatccagcctcagaggacttgggtatgttcttctcaaggacaggaaagtcatgcacagtgtatgttcattcatttgtgaagttgtccttgtggccacagttgaaggccctcatgctcactgtcagcctatacacctgtcagtccttcccataagacatactcaacaccaacctggttaactgataatgctgactacaaccaaggcaacttcctcctactttaaaacccagcagtacacaaatgggcgctccctacaggccaagtaaaattccttcatgcatctcctaatgactccccaccaaaatgctgccaaagagtcaatactgccacctcccccatgtctgtgtactcatccctggaacttatgaatatggtagcattcatggtttggttctgtgtccccatccaaatgtcaccttgaattgtaataatccaccatgtcaaggatgggaccaggtggagataaatgaatcatgggggtggtatcccccaggctgttcttgtgatagtgagtgagttctcagaagatctgactttttttataagaggcttcccccttcactgggcacccattctctctcctgccaccctgtgaagaggtgccttccgccatgatgtaagtttcctgaggcctccctagccatacagaactgtgagtcaattaaacctcttttctttataaattactcagtttcaggtatttcttcatagcagtgtgagaacagactaatacatcgcaacgggagtttgcagaaatgagtaggttaagggtcttgaggtggggagataattctggactatccaggtgggtccagtgaacaagagaaagagagagagagagagagagagagaaagagagagagaaagagaaagagagagagattgaaacctgaaggttactttgctggttttgaagatggaggaagggacctcaagccaaggaatccaggcagcctcaagaagccagaaaagggagaaaagaggattctcccccacagcctccagaaggaatgcagccctgcgacaccttaactttaggacttccgacctacagagctgtaagaaaataaatctgtgttgttttcagccatgacatttgtgataattttttacagcaaccactggaaactaatacacatattactgaactgtgagaggtagaggaccactagcctgcattttctcatagaagctatagcatagcattaataatagtggtaataataattgttccgcttaaaaattagctaatgcttgcaaagtgcttactatgaaccgggcattgctaggctgaacatccaacatacatagtttccttcaattcaccaaggtaggcactcttaaaaaacacccatttaatagaagaggaaagtgagccacagagaagttaatttgctcaaaattgcatagctaggaagtgaactctggctagggtctaaacctagacagtctgagccttgtaacctacactaaaataatggtgtacagtctatgccacataatttttgtgtttgattatatgctttagttatattactacctttgctgtcataggcccattagggtattatttaatgtagtcactcatctaaatcttcattcccctcttcaacggctctacccagtgctcatcactcttctgctggagctgggagtggtggaagacctgaggttttcctctaggtagaaggaactcccattatgaacactcaagagtaattctcaacggatcagaacttcctgagagcaggacactctggattacctgagaagcactcccagtctaaccctttgacccactcaagagatgtcctatgtcttagagggttctgccctggccctcctctggccacacccctcttcctggagcaaagagtctgtggagctaaaaagctgcacccacaacagcacatgcttgcccttcagactatgccccaggcacctgagccccagaattccctgcccaaatggcctgggcttgattcagggcttgtgtaggcagcttcctcccatctgtccttctgagagtggactgttccagtgatgtgcctaccctgagcccgaaggctgcctgaagggctgccacatgtaggggatgtggatgaatctgagatttgtgggctgggtgtctgcctatgtgtgtgcagagaaccttctaggcagggcagagctagacaagagaaggggtctgggctgactctcccagttccactaagttctggtaaagaattctgaggggtcagagaattctaagttagaatctggcctctaaggtccttatgaaggtgtactccttaaggtaagaggatagcatgtattttatttaacagcttgctagtgtgatttagaatttttaaacattgagatgagggccatgtgaacccacacttgtcttcttatcccaggtcctgcaaatgttaggactggactaaccactccctctcaatagagggagagacagagaaaggccaggtaatgaatagagtgaaaaatgtacattagaaaaatgctctttcaaaaagcctagaaagaaatatagccaaacattagcagagtctgcaatgtctgagttttggggttatggggatgttgttttatttcacttacagatatacacctacgtaagcagctttataataagaaaatatttgtttatgaattcaaacttatgaatattcaataagttcccagtataatgtcagcattagactaggatgaaaaaccaaactaaaccaaaccaaatcaaaacaacaaatcttcaagacatgaaaaagaaagaaatggagaaatatggattgggtaatgaagaatgtatcctcttaggcactttcattaacaacttgaaaatagaccttgacagaatgatgacctaatttctatatgctcttgaattggatggtctatcggaaacagaatcaggattcaaaaacatccccccaccgtctgacatcactgggtaatctaacaagattacagaaccgacttttagagaagagtttaaatcccagtactagaatatatgtaacagctatattggctgtgggagttatagcttaacagaacatgtgtcataaagataattaacatacaataaatgcatctatgaaagattaaattaatctaaggtaacactaatagaaaaatacagcataaactgaaggtgtggatagttttcttttgctatgtggtggcaagacctcacctggaatctgtttaatttcaataccaactttgggagacattaaaaaaaaatactgaagcctatgaagaagaagttctctctcatttgaaaaatttttgaaaaacctaatctagtattttgaccatgttaagaaggaaggacacatgcatgtttggaccagggtgttttgtagagttggtaatcttcttcatggcctgctttaatgactgaaggataagcccttcacagaaggactaaggcttccaagtaccccaggacaacagagggaggttgattttagctagatataaagaaaaacgttgtaaaaatcagaactgtttgaaaatagaatggatgcctttagaagagagcaagtcttacttgcagaacgtgttgggagtttaaggaaacccaatccatgacacctactatccctgtctcagcttgaaaagaaaaatgggtcaactaatttttgacaaaggcaccaagaagacacaatggtatctggataggataatatcttcaataaatggtattgggaaaactggatatccacatgtaaaataatgaattgaacccttagcttgtatcatacacaaaaatcaactcaacatagatgaaagaacttaacataggacctgaaatcataacattcctagtagaaaacacagggaaaccccatcgccttggcaataactttttggataccacaccaaagctcaggcaacaaaagtgaaaataaacaactggactacaccaaactaaaaagcttctgcacagcaaaggaagcaacgaacagaatcaaaaggcagcttacagattggaagaaaatatttgaaaaccatgtatttgataagtggttaatatccaaaatgtaaaataaatgcctacaactcaatagcaaaaaaccccaaataacctgattaaaaaacggacaaagagcctgaatagacatttctccaaaaaagatataaaaatggccaacaggcatacgaaaaggtaatcaacatctctgaccatcagggacaggcaaatgaaaaccatgagatagcaacttatacctgttaggatggccattatcaaaaagacataacaagcggtagcacgggttggagaaaagggaaccctgacatgctgttggtgggaatgtaaattgttgcagcctttatggaaaacagtacgaaggttccttaaaaaataaaaaaatagaactatagcaccatatgatccagcaatctctctgctgagtatatactcaaaagaagtaaaattagcacctcacagagctgccttcttatgttcactgtggcattatttacaatagcaagatatgcaaacaacctaagtaagcatcaaaggatgaatggataaagaaattgtggaatatattatatacatatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaataagaaaggagagcaggtggagtggcatttttatatacaagatcgctaggatggagggcatgacttgtgtatgtagactagcgggttttctaatatcaaattttatgcttgtggaaatctatccacccaagcttaggcagagccagacttcctcgaaaaacagagcagaatataagttctctgcagagcatctgctaccaagaaaaaaatgggcgtggagcatgatcagtttactctttccaaacttaccagtaagtcactccacctctcctgtggtggcatggatttgtattatggcgccactgtttactagtaccatgtacaagtaaatggtgcagtcatgtgaggaatgaattggctactccacggaagtgcccagcacagggcctggtgtgtaatggctcttcataactcttaccttgttggctaccccatagttattctccttcatcttgtctttcctgctccaaccatagaccaagcctcttgtttcctataagattgagactggtaacaggagtccgtggagcttgtgaacttggatgggaattaattatatatttaatatcactaatccctacctgaagtttggtgtttccttcagttataaacataggtatgaatatcagtagtgttagtggtatctgtgacttagtcatagatgagaatcacagatatcttcgtatgattttagagcagctgtagacaccttgaaataccaactatgttcaccattactttttttttttttcggcaatggagtctcgctctgttgcccaggctggagtgcagtggtgtgatctcggctcactgcaagctccgcctcgtgggttcacgccattctcctgcctcagcctcccgagtagctgggactacaggcactcgccatcatgcctggctaacttttttttggttttaatttttagtagatactgggtttcaccatgttggccaggatggtctcgatctcctgacctcgtaatccacctgcctcagactcccaaagtgctgagattacaggtgtgagccaccacgcccggcccactattacttatttttattttttgagatgaagtctctctgtcaccagactggagtgcagtggcgcaatctcggctcactgcaacctccgcctcctgggttcaagtgattctcctgcctcagcctcccaagtagctgggactacaggcatgcaccaccatgcccagctaatttttagtagagacagggtttcaccatgttggccaggatggtctcgatctcttgacctcatgatctgcctgcctctcaaagcgctgggattgcaggcataagccaccatgcctgacccactattacctatacttatagtagattgcatgtgatcgctgctgtcctatcaactggtgtgatggagctgccaacttgggggaatgcagtcacctcttcccacactggtgacccagacattcacgttgctttccagtattcccatttgcgatttgtttttggtcatcacgaggaaggagggtactcattctcatgcatggtttattgttcccaggtaaactcagcaaaaatgttctttgcactggtatttctttaaacaataaagttttactttaacttgctatattttaaatgcacggtattgacttgttatttttatttacatatatttttgagacgaggtctcgctctgtggcccaggctggagtgccgcggtgcaatacaacttgccgcagtcttgacctcctgggctcaagtgatcctcccacctcagccttttgggtagctgaggcatttttgtattttttgtagagacagggttttgccatgttgccgaggctggtcttgaactcctgagctcaaggaatctgctcgcctcggtctcccaaagtgctgggattacaggcaagggccactgttcctggcctgacttgttatttaattcattcataaagaaacacatattaaaaaccatgaatttctttttattactctgataactgcattttcctttcaatcttatatattttatatatttaaaaatattattcaagataggctggtcgcggtggctcacgcctgtaatcccagcattttgggaggccaaggtgggcggatcacgaggtcaggagatggagaccatcctggttaacacggtgaaagcctgtctctactaaaaatacaaaaaaattagccgggcgtggtggcgggcgcctgtagtcccagctactcaggaggctgaggccggagaatggtgtggacccgggaggcggagcttgcagtgagccgagatcgcgccactgtactccaacctgggcgacagagtgagactctgtctcaggaaaaaaaaaaaaattattcaagatagtgtccaaactgttcatcaaactgccaaatggatctctagtacaaaatggctaaaactctttcccaggagtgtgagaatgtatatcaggaaaataattacatcctaaaaaaagctgctgcttctgatgtgtggggaaatcaacatttagggaattcaactgtttttagtaacttccccccgaagcttttgtttgtgggattactatttacaactgtaattgggatacattttcaaagaaaacttggctcaaatttagaactcagacacttaagacacttttccttgagaaaatctaaatatttatgcgtctccaactcactttcaaaaacattttaaagcttaagatgttattgagagttccccactgttgatgatggtgattaaaaaggccattaaaaatggctcccaggaaaagaacagttgtcaggaagtcagggcagccgggaggcagaagacccaccgatttgtttctttgacactggcggtttagtcacacagtgatcgatttctgagaacactggagatgtgctggaattagtgtggaatttctacactctttggctctgactgggacattccgtcattacaacgaaatgagactgtgctttgctgtctcgcatcctctgtgaagacgttatccagcatgaaaaggaaggcaatggaaaccgagagccagcatacaggagctgctaacagaaaaactggtgggcgagctgaggtgaaatggcttggacacaaaccagtgcatgcagttctaatgaggcagtaaggcaggcacggaagtgcgcatgatgtcagctaattaacttggatgatgttggagagtgaggtatcctgaggaaaagccaacagcacttaactcaccagtgtggttaattatcagagaatgctgttcctgtgtagtttcctacccagcattttgaaaagatatttggctttaaaagtattaaaaacatgaagtgactcttcttgcaggcgatcagcagcttgtattggtgatggaaaaaaataatgggacttggccaggcgcggtggctcacgcctgtaatcccagcactttgggaggcccaggcgggcggatcacctgaggtcgggagttcgagaccagcctgaccaacacggagaaaccccgtctctactaaaaatacaaaattatccaggcgtggtggcacatgcctataatcccagctactcggaggctgaggcaggagaatcgcttgaactcaggaggcagaggttgtggtgagccgagatcacaccattgcactccagcaacaagaatgaaactccatctcaaaaaaaaaaaaaaaaaatactggtacttttccttaggataaggttaatgaatcaaggtgatgaagatggcctttcttaattcagttgcagcatagaagaaaattaactttgtttggtggataatcattggaagtgtgaaaggataagttgttttcagaatactttttagaaataatttttagttttctgtatcacaaatgggaaattaggaaaattaaatagatacatcatgttattagaatgcataagcattacaaatgtaactatcctgataatggtagcaaatatattgaagacggctcatgcaggccttccttgcttcccagtattatctggaggggaagataatcagcctggcaggatggaatagagagggacaagatggcgaccagtctccgaagcaggaaagagcggcatgaaaagtggctttaaatcaacagatttgtgtaaagtgcaaatgaacggttgtacctgagctgtatcacagtgaactaatttaacaaggagcagttgcaatgtgttccattttagctattctgaggacaataaaatgacaatatacacaggcagattaaggatgtctctttcaagatttggggcctggttgatttactcataaatcaaatgacaatatgatttattgttcatctgaacaaatttgagagtgaaagggaacatagtagcagctactcctgaacaacgggcataaagcagcttgcctcgggcaaactgagtagtgtggctcccaccacttctcatgctatagttccacaattatgtgtctctttttcacatgtattatgcctctctttacagtatgatttccacgggaatgtgagatttacacattgtagatgcagaattatattattgcacttattaataaaataacacaagtagataggacatacagtaaaataattactgtttaccatcagtatagttacacatgtgataattgatctacaaaatactttccaaaggattatttcatttaactctcaaaatagctgttatgtggcttcttcaaaaaattctgaatgatgtggccagccaggtgcagtggctcacacctgtaatcccaccactttgggaggctgaggtgggtggatcatgtgagtccaggggtttgaggccagcctgggcaacatggcaaagccttgtctttagaaaaaaatacaataaattagcctagcctgctggcgggtgctgtagtcccagctactcaggaggctgaggtgggacgatcacgtgagcctcggaggttgaggcttcagtgagctctgattgtgccactgtactcccagcctgagtgacagagtgagactttgtggcaaaaacaaaacaaaaatgatgtatcaaataaacaagtaaataagttttatgtggatatactaatgcaatgatgcagctatagtcatcatataaatatgtaattcattaaacaaataatgatatttcataaaatgaaatactatagaacaatgaaaacaatttatacatagagtgtaacaatttggatgaaagaaaaaagatatatttgcttatagatgtgcagaaaatttctggaataacaacgctaagtggctgcctctagaacctgtaactgaggcctgaggacagggaactaaatcgttctgtatgccgtatgattgttgtgtggtaggtgattacttcgcacaatgatgacatttgaaaaatagcatcattatcactatatttagtacgtacatgcccataatagagcagttcataaaacactatctacgcattcacatgtataataatactaatagtttaaaaagtttcaagtgtgggtatgtatcctaaaatgcctagaaagataagtaataataagtagtgagattcctgatcttactggtttttgctttttatgttaactttctactttttcattttgcttgaatgtgttataataatacatttatattttataatcagaacgcaagcagcaatgccacttccatcttgaggaagtgtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactggggcaccccctccctgtattgtgacagtgtggggctggtctccaacttccctagcctctgctttccaggtgcaaggtggaaatgcacttcccatctcctttgaagttagaccaggccacacgatttgctctagacaaagagttgtgagcaccagtgacaagtgtcatccaggtgagagctttaagggccagcacacaattccttgctcccttccctctggtgcgggatcatggaagcccaggtgaaggtgagcctctgtcagcctcggccttgatgaggagggcagccttcagccgtgtgcaggccatagcatgagcgagaaatgaacttttgttgggtgaagccactgagattttggagtatttattatcactgcagcgtttcctatctgatcatgactatataatttgtgaagcccagtgcaaaacaaagacacagagccccttcttcaaaaatgatttagcatttcaagatattagcagtagagcctcaaactctggggggccctgtgagtatggggccctgtgagtatggggccctgtgagtatggggccctgtgtgactgtacaggtcgcacactccaagctggccctattttcctattccaccatcacaacaatcctggaaaagaatcttaattctcttatttcacatatgagaaaattgagagcttaaacagcttgcttaaaatagcagactcacaaaatgccagaagcgagagtttgattccattggtattaataacactgcgatgatgggtcttttgtgcattcctggttctgggctttggggcacaaggagccaagtacactattacaggaagcagacaagactcaggaaatatcgtctcctttgtaggaaatcacctaactggaaccttcaatggaaggtaagaaagagttaacgtctaacccattacatgctaagtgaatgttttctcttgccagaaagtataattagtaatttcaggccttatctgaaatacctgcctcagcacatgctgaaagtatcaataaagaaaagcaggcaccgcttttaatttcattgctataactaattagcattagagaaaccattttcataagcagtgtgctaacaacccattggtaactggaaaggaaagctgatggtgcagctttctccatggtaaccgggcaaggagaaaagcgcttcacagccacgaagagggggttcctgagggaagcacgagacgcgggctccaggcagcagcacgtggaagtgggcaggcactgcccctgacttcagatgccacaaagaacattggcatattccagtcaagggcagtgttttgaactgaaaatattacatgccaccatagaactgttttctacatattccttaaaagctattcaaaccgtatcaagatttttttagaaagggctctaccaattaaaatcacattggtttttcctaaagaattcctatcaactctcccacccaacatatcctacctctgtacccagtacagggggcagaaggcatcaggaaaagtaataaaaagaacctttggctgggcgcgttggctcactcctgtaatcccagaactttgggaggcagaggcaggcggatgatgaggtcaagagattgagaccatcctggccaacatggtgaaaccccatctctactaaaaatacaaaaaattagctgggcatggtggcgtgtgcctgtagtcccagctactccggaggctgaggcaggaggattgtttgaacctgggaggtggaggttgcagtgagctgaggtcgcaccactgcactagaacctggcgacagagcaagactccatctcaaaaaacaaaaaaacaaaacaaacaaacaaaaaaacaaaaacaaacaaggaaaaaaagaacctttgccgcacaaagagggtaggtagtgaatctggtaattttaaaaggcagctgtcattaaatcctgagtttcaagatgaaatcctatcactctgtttgagcactttattattgttcttactgattgtgccctagaacacattagtgaattggcacaattcctctgtcattttcttctcttcatataaacttagtttgggcaatttttcaaagaaggaaggaagaaaggaagtaaagaaggaaggaagggagggaggggggaagccaaaagaaacaaggattgagtttgttggagtcactttagaacattagtgccacactggtccataaatatgttcattttgcggggggtgggggagactgcaacaacatcatactgtatcaatgatgaattcagcagtcacttaaaatgaaaaatgtaggtggctttcaaagaaacaatctcaagtaaaattgttaacaaaatttatcaatttttgaaaactgtatattcaaatagataacataaaaacaagaataatttaaagcatgttactcaagtagatttcacaacaaatgatacatttaaagttttatggctccaatattaatgctttaggaactgtgtggcaaacatttactaaccaggttctcatgacctattgactgtgtgaagaatatttgtcagcatgccagcgtgcagtgttaggttctgttaggatcaaaacaatctccctcaggaagcttatataaaaagttgtccttgtccctactcttaggtcaagaaaacattgtcatcaatatgaatatgaagagatgcatgaaataatatgactaagttctttaagggagaaagccgccatagattagctagttagtttgagaactggcttttaaatacatactttctctacataatttggaatgttttagaaaacaaaatgggaacaaagtacaatgcacattagctgggcagggaagcatgaagaatgctttctatgttacggctaattccctgcaagctagcctgactttcagagcattcaactgagtacgtggctgttctccaccatgaggccagcacgtggttaatgaccccaattctggcattgtttctgggtcttgtttttttctgcacaaaggttaattgaatttttacaagggtttcctagaggacttgcacaactttttggtattaaaacaaaaggccatcttataatagacttacaatatgactttcataagcactttaagtattttagcttagactttagtaactgtggcatatttaatgtttcatagctttttgagaatttccacagacattctcagcatcttcactaaatttaatcacgaagtctggcagtacagaattcttccttctccctcggcttctttttaagtttgagagtgaatttggttttgtaaaagtatgctagggagaagatgcaagggacttctcagcaatttctctctatgtgttctgcagataaatgttctttccggctcgtgacaactaacaattgtgtttcaaaaaaaaaaaaaaaaacatgcattgttaatgagacttcgccagagatgcttagagttaggtgaaatagagataactattttcatagctatgcattaattgactgaattggctttgtatttcaggccaactccaaagcactggttaatagttataaaaatgtttcacagtgctccatgtcggcttccccctgaaaatccatgataaagattgagcgtggttgaaaggcttgtcatgcgtaagtgctaattagccccaggatgcttgccttcatgaactttcaggcctcatctataaggtcaggaaaggggtcatagctcatagaatatggacttgcattaattcccagcgtataaactcatggatcctccacagaattcactaaacttcaataagctacaattctatccttacctcacatgtcacatccctaaaggtgacatctacattaatgcccctcatccccaatagagagcacattggtagctcaaataggctattactcactgtgacctcttctacttatttcttaaggcatgggagtggcatagtgagatcctggcaggagcactgttcacaatagcaaagacttggaatcaacccagatgcccatcattgatagactggataaagaaaatgtggtccatatatatcatggaatactatgcaaccataaaaaggaacaagaccatatcctttgcagggacatggatgaagctggaaaccgttatcctcagcaaactaatgcaggaacagaaaaccaaacactgcctgttctcacttataagtgggagctgaatgatgagcacacatggacacatgggggaacaacacacactggggcctgctggggggttgtggggagggagagcatcaggaagaatacctaatggatgctgggcttaatacctaggtgatgggttgatctgtgcagcaaaacaccatggcacacgtttacctatataacaaacctgcacatcctgcacatgtacccctgaacttaaaatgaaaagttgaagaaaattttaaaaaaagaccctgcctggcagggtttcagcttaaagaaaatttctgggttttgcacatggccattttctgaactcctataactggcttttgaaccaaagtcctcttggaatgctgagacgcactggaaacctctagatgggccatccagcctgaagaaagcctttcttgttgctgctatttgtatcattatttcctttactaacaataactaagatgcactgggtacgttacgtgttagggagcgtcccaagtgcttagtaagcatcgattagtttcatttttacaaccatctttgccctgtgaaataggacatgggattcactctttttaaagatgagacagttgacacttgggaagcttaggaaggtttcccaaagcaagctgtgggtacggacggcatcagaactaaacgcagggagtctgactcagggtgttcaatctcagcactactgaagtttgagaccaggccattctcacgggcccgttgtgggcactgcatggtgtttggcaccatccctgcctctacccgctagatgctagaagcatccccctgttgtgatgaccaaaactatctccagacatgaccaaatatcccctggggacaaaatcgctggcaactgagcaccactgctctgactcaaaggtgtctgctcctaaccacctgcctctcaaaggtgtctgctcctaaccacctgcccctcaaaggtgtctgctcctaaccacctgcctttgctgccgccggcttccccctgcttctttgaggcaaaaatcaggtcggactagcatcagtggcaaaggaaccagtcagatcagctcatgtgacagctttgacagaccaagcattttggtcacatattagcttttgagaatcaatatgcataggctggaatgacactttcagtaaatcaacattcaggctataacaaacctattaatattctggggaattcattgtgtaccgagccagtcattcagatgactatatgccttaggtctttttatgaaataaattagatttaatttggtaggctaggcagagtaggcagagagtgccttgcatttcctggttatactagtgtgtggtgtgataaaaaactgaataggcatctccatcaaatgattcctgtaatgtccccattggctcttttgaaataaaacctgtgtcctgtttccctcttcctaattcaccttgctcttgcctgtgttctataatggacaatgtgaacactcagacagggctgattttctaatcaatggtaacaactggagttagaaatgaaaatattatcatagtaaactatatttattttaaagtccataggctagttttcatcccctcccaaaccactctaatttatataggagggggtcaaagtttagaggaatacgaagatgtttctaaaatttagatgcaatatgtataagagagaagcttctacttgtgatgaattagttagaaatcaaaatttttttggacagattcacttgagagaatgaagaaaattcaagtagagagaggtatcctgagaaaaacagaatattttagactgaactgggataatctggagacttagaacaataatatataaggctttatatattatatatatattgctttatattgaaatttcatggaattattttagctcttaaagtataggaaaatcagttaaagatggaaacactgatgaatctaatgagaattttaaacatataagtttatttatcttaaactgtaagattctattaggctttaagactataattttatggactgtgaaagttctaaggtcccttaagattatgtagaagagatgtttactttttagcaaagaaaatattgtccagaaacccattttttagaaacagataaactatttatttttaataaattaagcttatttttggtgaacacaaacttttgaaatttagttttgtgaaagacacatgtaatcatgtattatttcgttctttctatatttcattacgttgcctagatcaagcaaacactgatatacccagataagtgtggcaaacagttatgtgttttttttaaacacctcattttacaattttgtaatgcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataaggattttaggaacgtgttctgacaagcagtggtgtgaatacagcttctcacataagaggtgagttaacagaggctcggagcagataagtcactggtgctgagtcacaggctggcagagcaaggatcagaatgcaggtcctctgccttttaagcctgcgttctttttggttcacactgcctctattattaaattacttaatttatcagagcaaaaagcaaaaccttagggatgctattagcaatttactatttccagttcttttgggaatctgttaattgccctttcataaatgctgctcattatgattaagactttgattaaatgtgaaagtctaggatttatatgttacagacatatttaatattaatttaaagcaccagagcagaatgaattgtgcattccaattttttagctctatcatacactctttaatcaaggatttttcaagaacttgctttgtgctagcaggacctgatttttcccctcaggaagctcacagtttaattaaggagagctcatattagtaacaatgcacatcagtgtctgagtaagagtttaggggaggtgtagctcgtcttcatggaggttaggggcaagtgagtttagtgaataggtgccacggagtgagacggggaaagatgggtgtcctggttgaggggcgatgaggtaagaatgactaatgcttatgaaccattgcctgataaacactgtgcccaggactgtatatggatcatgtttaatccaaaagcaattctgagtgaagtcctatccctcaaccctttttacaggagaagacattgaggcatagacccatgaagtgggcttgctcagtaacaactgctcagtgaaggggctgggactcccagcacttgcctggttcagatcacactactgtctccttcctatactgccccttcgcccatctgtgtgagccaaggcaaggaagacagtctggggcctgtgggatggcaaaggaattttctagaactaagagtgtgtgttgggaaggtaatgagatgggtttggaaaggttagtttgggtaaagcttgaaaagccagaaaaaggattttagcccatgttctaagccttcaccattttgtagaccatcttattcacattttgatggtcgcttaggtaaactaagatctattttagacttgcaaacaactacaaggagaaattagttgaataatattaaatattgactactgatatgataatatgtgtattcatgtaggaggtaggggttgtgccttcttttccattcattcagaaaaagcgcctatggaggctcgcgaatagagaggcaccatgctcattgctttgggcataccctgcctccagcatgaagtctggcactaggaatttcccattaatgttcagtgaatgaatgaatggaatttcctgccctgctccttgcctccctcccttcccacctccccctaccttccttcctctttttcttccctcccgtcattaaacacatatttactgaatacctacaaaacttctatgactaaaaccaatgagattctcccatgaaatggggtggagagaggggaaaggcagaaaataagcaaggcaattgaataatgtaattccagttagtggtaagtgatgaagaaagcagggctggcttacagggtgagatcgtgcagtggttggggaaggcatggtctaagcaggcctctcctgggaggggacacctgtttagagggctaaatgaatggaggcagccatgcaaaaagctgaaggaaggtcctccaggaagggagagtcatggccctaggaagaggacaagtctgcttcatttagagaacaccatgaagggccagggtactggagcattgtcaacaaggggaaagtgatcgggccgaggacagaaggccaggtcacataggtctttgtagtgtgagaagaactccaaattttattctccggagtggagctgcttaaactgttagtataaattataatggaatttaagtaatgttcacagaggagcagagaagataacagagaccgagaaggacatctgaatttattatattttaattaatttttttagagatagggtcttcctctgccacgtaggctgaagtgtggtggtgccatcatagctcactgcatgaattcctgggctcaagtgatcttcctgcctcagcctcctgagtaggtgggactaaaggcatgcaccaccacacctggctaatttttaaaattttttgtagaggtggggtctcactatgttgcccaggctggtcttgaactcggcctcaagtgatcctcccaccttggcctcctgaagtgttgggattacaggcgtaagccaccacacctggcataacaaggaatttttgacagtgaatcttgactactaagagactaggggaccatgaaagaaaacagtacattaaccaggaaaaggatggctgatacattgaatgatgaagaggaattaaggcaatggaaaatagaacacagacccttggagatgaagaggtcacgatttaccattggctgataacctactgtgatgacatttctcaggaacgaggcgactagaagaaaaacatgaaagaaaagggggctaagagttttcagaattctcacaatactttttaaaaagagtctcaaaaatcaaaaccagttttggcatactgatttctaagacataattcactctccttcttcctatccctcccttccttccttttcttaatagaaattgttttatttatacattttgtattttagttgccttgtcagttaagtgattacattcatactggaaaaaaaaaaacatgggcaatataatcataaaaatacaaatttctggccgggcacagtggctcatgcctgcaaccccagcactttgggaggccgaggtaggtggatcacctgagttcaggagttcaagaccagtctggccaacatggtgaaaccctgtctctactaaaaatacaaaaattagccaggcatggtagcacacacctgcagtcccagctactcaggaggcgaggcaggagaatcacttgaactccggagggcagaggttgcagtgagccaagatggcgccacttcactccagcctgggcgaaagagcaaaactccatctcaaaaacaacaacaacaaacccaaaacaaaaacaaatttctatatttaaaaatgatgtatgtaataatttttttttgctatacttggaacttttttttttaacctactagggatctaatacatgaattatttatgcaggaattcctagattgtcattactacaacacttatggtatatttcttccttgaattgttgagacctgatttattaggtgaaggatgacattgttttcaagggaaaggaatgctgttaaaaaccaagctgttatacaaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggtagctgttaggatattccaacttaatgtcttaccaggaggacctagaccagcaattacaatacaatgacgtaagcattttcctcctctagtcaagttgaagaagaaaagaggagctgacaaacataaggccaaggagtatccctggtcacaaaggctttgaactcttacccaggtgtggagagccatctttggcatgctcgctcccagcacaaaagtgccatggcggtggtctgtccctctaatctacgtaaatctctctacttttctttcttgcttgcttgcttgcttgcttgcttgctttctctctctctctctctctccctctctctctctctttctttctttccttttttttttttttttgagacagagtctcactctgttgcccaggctggagtgcagtggcatgatctcaatctcagctcactgcaacatctgcctcctgggttcaagcgattctcctgtctcagcctcccaagtagctgagcttacaggcaggcaccaccacgctcagctaatttttgtatttttagtagagatggggtttcttcatgttggccaggctggtctcaaactcctgacctcaggtgatcctcccaccttggcatcccaaagtgctgggattacaggtgtgagccactgtgcacggccagatctctctacttttcatagatacagagagggtttggctgtgtgtccccaccaaatctcatgtcaaattgtaatccccagtgttgactggattgtgggggtggggttctcatgcttgtgtgagcaccatcccatcggtgctgttctcgtgatcatgagtgagttatcgtgagatctggttgtttaaaagtgtggtatctctcctccctctctctcttccccctgctcccgccatatgagatgcctgctccccttttgccttctgctgtgattgaaagtttcctgtggcctctccagaagccaagcaggtgccagcatcatgcttcctatccagcctgtgaaaccatgagccaattaaacatcttttctttataaatcacccagtctccggtatttctttatagcagtgcgaggatgaactattacagataccattgcctgtgttcagatttctttagagtcgagcactttcagttatatatcagatgacttcaagatcttttgaaatgatttggttctcttagaaaacttcgtatggacagttgggtaggtggctgggctgatgggcagggtgatgcctgaaggaagaaggatcgtactcattcatttccccaaggctttctcgattgctctgtgaaccacacagggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctggcatattaggtaaagacacacatttcagagtggcatgtagagaagttcaaatcccagccatttcatttgctcctggaactttgtacgggaaagtgacttaacttccttttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcccgactaatttttgtattttttagtagagatggggtttcaccatgttggccaggctggtctcgaactcctgacctcaggtgatccacccatctcggcctcccaaaatgctgggattacaggcgtgagccaccgtgcccggcctatgacttaacttctttaaccttgttttttatcctttctaaacaagggtcaaaacattaccttcctcataggattgttgggagaattaagtaaggtaaaactcataagacatataagaactgccatcaagtaaatgctcagtacatgttagctgtcatccatctcgttgttgagaaccaaattaaatatcactctataagtgaaagcactttgttaagacctaaatcaatgttaattattataatgatgaggttgagtattgcttcatccttgatgctactctcctcagtaactttgccaatgatttaaagatgtagaagctattcttgtcagatggatggcacaggcccggggtgggtctcctggtaggacaagaccaagattatggcctatggtcttggacaagaccaagattatggtgacagttgaaattgataaggggtaaaagtaaaagtttcttttatgttcaaaaatgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattaggagggccttattatattaggtagaaagaaccttggcaagtcagtgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaacgtggtgttcccagtggatctgagtagaggctggtgattgtgggaagattctcacactgggtgtcatgttagaccagctgacctctaagggccctatcatgttttatgattttataatatagcaggctgtacagaccatttttaatatagtcttaatttttataaaaatgtattcatgcatatatacatagttataaaacataaccgttaaattctagttaaatgccaccaaagataaaaataataaagtagcttcaaattgtacttattgcaaggtgacctatctgaaatgtcttcttggtcatattataagaggacttaagatgccaaaggggaggatcatagcctattcatatttccatctcccacaaagtgtctggcacacatgtaataattaaagtagacaatctttattgaatgttctcttgtttaaagaagtattttaagcccattatatttaataattcacttaaccatcaaaactgctcaataattttgacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagggcacagattacacgaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccttcaattagcattccttcaaaatgccatctgtaagtgactaaagaagtgacagccagaaggcagaacacagggctatctccgcacagacaagacaagagccgggaaggcagggacgctcgatcagccgtttccagcaatgttaacgggtccacccactaaactaaacaaatgctttcttcctaccatggagacagaaactgaaaaataatttttgacagcactgtatgatttagtgggtgcttgcagacacagcctatacttagttttataccatatttaatagaacatttcaaactttcataattatttggcagcttttaaaaaataaaaaataaataaataaatagcaaatgcccactgggttactcagtgcaatgaaaataccgtatcatcaggactttgtgatgtcttggcaactcttaccccaactctatccaacacctgctctccaggtaggtcaaggtcaatatacttgactacttcaaagcctcaacaaaaatgttctccatcaccatgttatcaggtgtccacgtcagctgagaagcctgactggtccttttcatgcctgtggaacaagggactgaatcttaaggagagtggagaccttgtgttacttacattctgcattcaagaaactatttctatgaagtttaatgatcaatgatgctttttccttcaaaactatccaaagatttcaaatctgtttgtgcaaggaggcactggattgaactgaatttctagtttcttcatcgactggttccttcattcagtaacaaaactgaacattttaatgtgctgatactgtgtgagagctttacacacattaactgatttaatcagtatgaaaacggtctgcaataagcacatgtattcccatcttacgggcaaagaaatgggctggagaggtttcaggaacatgctccagctggctgaggtgcatctgatgaactctgtgcttccagtgaacttgtaagatccaagtctccaggcgaacatcaagttcttctaggattcatccccagcctttccccagtcttctaggactcctctcccttgctccgccttgaactctgttgttgacatctttcttgccctctacaccgttaaacgattctagagtggtgctatacattggaaataaaatgcgagccacacatataaattgtattttaatatccactttaggaaagcaaaaagaagcaggtgaaagtgattttgataatatattttatttaccacaatatatcaaaaaatttatttcatcctgtaatcagcataaaaattactaataagatatcttatattcttctatggtattaagtctttgaaatctggtttgtattttacatttgcaacacacctcccttcggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagccttcactgggcacgtgtctgccaggtacagactacattccctggcctctcctgcactcagggtcccatgtgactggatctggcacctgagatgtaaacgaaagtgaagcgtgccatttctgggttacgcccttaaagaaggcatgttcccagcccttctccttctctctttgtgcaagctggaaggcaggtatggtgccagtcaccttcaaccacctgagcacgctcaagggacagcagagccacagacgggagcttctgtttccttaccacagagccagccatggggaccatgtcctgagagaaagaggttcctgttttgttcacacaactattgttcatctatgacaagcacggtcatcttcatttactttcatcatttctagaatctaattccgtgctctcttggtggggttagacccaactcttccttcaggtctcagtgaagctttatttcagcagggaggcctttctaatgttctgaagactaggttacagccctcactccatactaccatggcaccctgagcttcccctttctcagcatccgtgcacagggttatttaatgttggtgttcgttctagacctctgtgtcatgggggcatgctgtgaccatcttctgggcacttggcacagtgcttagcacatagaagtgccaaacatttgttcaaagaataaatgtaattaagaggcttaacatgtaagtgatgtgctcttgcccttcccggtttgatgggaatacagaatctctttagattttcctggttcctgttagagagcatcagaatgacagtgcacacaggcaaggctagctgggaggatcgagtggcctgagtgtcatgggttgagttgtatcccttacaaagatatgctgatgtcctaacacccagtaccttggaatgagatcttctttggaaatagtgtcattgtggatgtaattagtcaaggtaaggtgtattagtctggtctcatgctgctaataaagacatactcgacactgggtaatttataaaggaaagagatttaactgactcacagttccacatggctggggaggcctcacaatcatggcggaaggccaatgaggagcaaaggcacgtcttacgtggtggcaggcaagagagcatgtgcaggggacctcccctttataaaaccatcagatcttgtgagacttattcactaccacaaggacagtatggggaaagccacccccatgattcaattatctccacctggcccagcccttgatctgtggggattattacaatttaagggatatttgggtggggacacagccaaaccatatcataaggtcataccaaagtaggttggctctaactgaaacatggctggcatcctcagaagaagaggagggagacacagcaagaaggtggccatgagatgatgggagcagagactggagtgacacagccacaagccaaggattgctggcaaacaccagaagccagaagatgcaaggagggattcttccccatgggtttcagaggaacatgaccttggaggcaccttgatttcagacttctggcctccagaaccgtgagacaacacatttctgctgttctacgccacccggcttgtggcactttataatggcagccctaggagcaaatacatcaaggcagaaaacccgtcacaaacctgctggcatgcccgttcctcctggctacgactccacagcctgttcccaggggtcagcccacaggccagggccaggcggcattgctggctagtggcctgcaggaggggcacttatcagtacttcctcactcccaacatgaaaagtcaggtaaagaagtacaggaagctctgccaaggagtggaagggatttgtacctccttaggacaacttcccaggtaagggcgagtggaggacagggtgtccccactacaggaagaaagagagacatcatcattcagctctcacagacattcctccttcaaaacagaccctctggcaaaggttatcctttaaagaaaaaaaagttcttgctcctctgtcttgaactgggaataaattaggagagataagagacagatattactcctttttaaaactctgtattcccattgaaaagagtcaagggtacaattctcaagtctgtgtgtgtgcacagtgcttacatgtctctctctctctctctctctctcacacacacacacacacacaccatatcccacttacagactgaatactttgcaccacaaagtattttcagctgctcttctcgctcctttccctttcaattcagaaggctaactctagctcaattatctcttccttttgacagaattcacatcaaatgcaaacaagatgagaccaggattctgcctggttctgttgccaaggtgggtgggaagtcggcagcagggatcagtagctgtagctgcttcagcctttgttgaggctaactctcctcccaaggtgtctcaaatagaaaggcttgttcctgatgctttccaattattttcacttcaaagaaatactttaatatatttagttcaaattgcatgatggtaattatgcttctaaatctgatcaaatgacgggagagaggaaacctttgcttccatgaggggatatttgttcttcaatagatgggtctaattttccacagtgggaggactcacaagcactgagactggcttttttcattagttatttataaagctcttattagattggttaaattcacatgtgggaaaaaagacaaattattgttaatcaatttctaacctatactattcataatttagctgatagaaacctctgctcaccaaggggatttttattcaggctgcaaatcagtatcatgttatagagtgtattaattaataaatggaatatttagctttttataattagtgtttgtatttattacatttgttatgttactcctctcctcaacgatcccattataattcctattcctcagtaaataaaagctcactctctggtttggaattcaagcctcctcccaacacaccacatgaccccgccgtgccagccattcacactgctcacagggtcttcagctcccttctccctgagagcttgtgggaagggtgtgctgtcctaacccagttagatgtcgtcaaatgccttgtttggccaatgaaatgtgggtggcaatgacatgtgtaacttgaggccagagcctttaatttctggcactcaactctccatccctcccaccatcctgcttcctgaaggaagggctccacctgccgaccctgatggagaacgaggtcacatcagtctccctgccaaccctattggacaggccttacgcgtgagaaacaaacctttgttgtttcaaaccactgaaatgttgaagttgtttgttactgcaacagactttagtctgtgctgactaatacatccaggatattctttgggaattctagcggctacattctatttttcaagtgaaatatgctttggaacacctatacataataaaagcagagatggtcatgttgaagagtgagatggggtgagtgtgtgtgtatggggatgggggaggattgagattcttctttatcttctactgaagcccccgatgctttgcaacctccgcacatttctcagaactcaggctgaaaccctgtgatctagtccaaaccaaccttcccagctagggtttcgttcaaaggtcacaactggtggcttgtgagcagggtctggacacacacacacacacattttttttttttttttggctcacagagtgcttgaaaagaatctaagacaacatttacagattgggagatcaacgtaaaagatgcatcctaaacttcccttgctaaagtgaagaatgaggacaccctgggcctccactccttcccttcagttgctatttgtcattacacataaatgtctgttgcatatagggaaatatttctgtcccatgtctctatcaaaagtgggaaagggctgtgtttttctaaaagtaagagaaagagtgtatttctttgtggagtgcataattctcctaagtatgaaagtgaaaagctaagatcagtgtttcccacccctcatttctctcgttcatgtcacctgttgcttcttattggctttggaatgtgggacctctcttctagcctcttgcatctacctctatggtttgacttctgaaaatgtggtccctggtccacctggatccaagttagctgagttgctcgtgaaaaatgcagattgcaggtttcatttcagacctactggattcgaggtggtggtggtttctgcattttccataagtaaccctttcccttgacaattcttaggcacaattaatcttgagaattactgctctgtggctgaggtcatcatatattcagaaccaagttctacgaatgggtaaagaatttttattctcttctagctttgaaagacccttcagaaggtagaatttggatgccaaaatgctatgatttctgaaatggtgtccaggaataatacaatgaattatttgaaaccgcagctgttcccaagattacagataaactgaacaccaagttgtcttctgaatgctgccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccctatacatgcacagcctcccccactatcagtgttccccacaagagtggtacatttgttataaatgcaaaatgtacattgacacatcatcacccaaagtcctcagtttacatgaggttcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctagaatatcatatagctgaaaccacacagtatgtagtcttttcagattggcatctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccgggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgcccggctgtgtttagttttctaagaaactgccagactgtcttccaaagagactgtaccattttgcattcccaccaacagtgaatgagagttcctggagctccacatcctccccagcatctggtggcatccatgttttgggttttggccattttagtaggtgtgtagaggtatctcattgttttaatttgcaaatgccaaatgacatatgatgttgaacatcttttcatatgcttttttgcatctgtatatcttttttcggtgaggtttctgttcagctcttttgcccatttttaatcttgttgatagttttcttactgtcaattttgaaaagttctttgtatattttggtaatagtccctttatccgataggtcttttgcaatattttctcccagactgttgaatgctttttttttaatggttggtctgtttccaggaatcagaaatcaggcttcacacccagcccagatgttcaagtggttgtttgacttgtctgccatctgcaactgtctctcttctgctttgtactccacgcctctcagatgctggagaaactggtcatttgttctctatagcatctcacattgtgaatttgtacaaggctcagtggcttcttgagccatgggttgtgtgggtctataaaccaaacagacaggccttggacagacaggggtttccttcaggcagcacagcctcagccacagcagcatcctgaggctgaggatgtaacaccaagatatgaagatataaccctacgtttctaagatgcggctgttctgggggaagatataacactacgtttctaagatgcgctgtcagtgagtgacatgagagagaaagtctgcatgtcttagttatcagccatgtgagaaggaatacctggatcactgaatcatctgggcataaaagcttttttatgagttgtgttaaaaactgctttttgtggatcacatgaagcaactctgaaatgcattatcctgatcatcattgttgctaatcatgtccattttgggccatgcactgcacatgcttatcattagtcaattgattaagtttgcactctttgggagaggcactactcctatccctatgttatagctgaggacgctgagacataaagagattaagacgctgtcaaccaagccaataacaatattttctctaagctcatgaacaatgtttggctgtgcagaaaaccaatgacatcaaaaggagagcttctagaagtaaacatgactgatggtaaaggaccccttctaaccaaccctgggaaattagcaaggtttcccagcaccccaagctacttgccttcccaccccttctcttctgaagcaacatcccgactctggaatccattcccacatttaaaaaatgggataatgtgagctgtcatttatgtgcattgactggtagggatgaggatagtaagagtatcctgaaggaggggaccagtaacaagcagggaagagagaaatgggggatttgggagtagcaacctctggagtaccagtgcatttatggaaagataatagttagaacacagtgttatcggctaggactaatgatggtggagcagtgtcggtgagggtatgaggtggctctgatccatgctctacggtgaatgtgtgggaaggacaggtgtggaatggttataagtacatgctctggagtagaaggctctggattaaaaacctgactccacagcttagtaggtgcgtaaccctggggatgtcgcttaattgctttaaccttcactttcttcattttaattgtaggaggagaacagcacttacttcatgcatttgtggcaaggattgagttagatgatacatatccaatgttaagcaccatgtctgatagaaacttcttaatatgttggaaatcttactattttatggttgatgaacgaatggttctagtgactttcagggtatgtcttctggcccaaggctaacagcaggtgtgtattataaaggcaaactgatctcccatgtagagggaggagatgggatctggaaggcctgggtgctacttgtaatactagattgactaaaaggagggtagaacgggagggggctgctgctgtaccgtagagtcttgatgaatttatggctgtcattctgaagattttaatcttgtctgaacaagtcataaaaaagtcttttatacaatagccaagactcatgaacttctgtttgctgcacactgtgctctttctgtgggttattcaggtcattctcaccacaaatatatgggataagtaccattttcatcctaaataacctctgccactaaataacctttgcccccactgcactaagacttttacatgttttaactcacttaatggctgcaacggccccaggaggtagatacttattaattaccctcatttaacagaggtttatggaggtgagggactggactgagggggctatgggggcgacctagtctagctgggttctaaggcagttgctctgcccccagagccctgcttcgagagcctctatgcttctatgaaggtcacaaccagaagcagtccggcctgcagttgctgttttaaaaaagaggttgtaaacatcactcactgcaccacagggtggccgtgacacaaagtcagatgtgagcattcttttagaatccactgtgaggaaaagcctgcttcccccaggaatccacaggcttctattctgataatgatgattatatcaccaccagagtccccttcagccttgatcattgagacaccctagacagggggaaagcattgaagaacctctgtggtcaacctaattctttgctatatccatgatctggattttcagccttgacttctagtttattatgatagtgttaggtctgtccttgttacatgaggaaaggtattaatatatttaaaaagctataccgatgacatgggtatagagacagaagatgtgacttcttatagttagaggtcaaaaagccataagatattcaataacttagaggcttgaagaaagatcccaaagggtctccaaggctggaaggatgggctgaaccgaaccacaagaaatctaatgagggtgacttaaaggcatgaacacagcgttatctgcacctcagagctgggcaaggtctgactccctgaggaagagccggcagggattgccatggggaccactccctgccaggcatagccttttcccaaccctgagcgtccgagcagggtttcaggcagggcgggtcggaaacctcaggtgtgcggggatgggaaaagggggtgaaccctgtgttccccagacctgtactgactgagtcatgttacaagtcaggagttgttgcagggataaatgggaacagaccaaacactgtgaaactttcttttttattattatactttaagttttagggtacatgtgcacaatgtgcaggttagttacatatgtatacatgtgacatgctggtgcgctgcacccaccaacttgtcatctagcattaggtatatctcccaatgctatccctcccccctccccccaccccacaacagtccccagagtgtgatgttccccctcctgtgtccatgtgttcccattgttcaattcccacctatgagtgagaatatgcggtgtttggttttttgttcttgcgatagtttactgagaatgatgatttccaatttcatccatgtccctacaaaggaaatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtgtatatccagtaatgggatggctgggtcaaatggtatttctagttctagatccctgaggaatcgccacactgacttccacaatggtcgaactagtttacagtcccaccaacagtgtaaaagtgttcctatttctccacatcctctcaagcatctgttgtttcctgactttttaatgatcgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactctttgatggggttgtttgtttttttcttgtaaatttgtttgagttcattgtagattctggatattagccctttgtcagatgagtaggttgcaaaaatattctcccattttgtgggctgcctgttcactctgatggtagtttcttttgctgtgcagaagctgtttagtttaatgagatcccatttgtcaattttggcttttgttgccattgctattggtgttttagacatgaagtccttgcccgtgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagactgttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggcagcgtgatgcctccagctttgttcttttggcttaggattgacttggcgatgcgggttcttttttggttccatatgaactttaaagtagttttttccaattctgtgaagaaagtcattggtagcttgatggggatggcattgaatctataaattaccttgggcagtatggccattttcacgatattgattcttcctacccacgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctctctgtttgtctgctattggtgtataagaatgcttgtgatttttgtacattgattttgtatcctgagactttgctgaagttgcttatcagcttaaggagattttgggctgagacaatggggttttctagatatacaatcatgtcatctgcaaacagtgacaatttgacttcccaactttcatttacgttacctgcaaactcaatagaggctgaaaaatttgttgcctatttaatgaattcatcaacaaatgctgattgaatgactgctctgggctggtcaaaaagggtcacaggcgagtgagacaagtgcagaaaggaggatgatgcaggtgggtggggcccaggagtggcaggtggctgtggggacctaactgggcttattgagaggcacacagccagtgctcaataatgctaacggtaaaagagtaatattgatttattatacatttaattctttacagataagtgtgatatggctgtcccaaaaagcttgctcagttgtaaactaggccattggtctgcagtaccaaaaagtcaatttggggaaccaccttctgtgagacattaacaaactgtaacccatttgggcaaggctgccacggagccaggagcagcctcacaggaggctgaggaggggcattaagcctccagagaagagacccacaagaggatgtcacaggccgcctgttcagctacactaagcagctcccaggagtgggtctcaagccatgagtgcatgtttcagggaggcagttttaagcctcacgtaaggaagaactttttaaaaattcctctcttcctaaacaaccttcctgaaagatctgaactttttgccacttaagttggacacctgccaaggaaggaaggtgtgcggaacccattccagtagtgggaaagaggtttggtgactaggctttaagttccttttcagcctaagattctgtggggctaagaagacgagtgactttttgtctaagtatcttttcagtgtggcatttgtaacattgctcatctctatgaaatggaatgatccatttcctatcaagtgaatttggggcatcagttctcagttttgacacaatgacttgggcagattattaaatcacattatgtactggtctgcctgtacatggcccaatttaaccctcgaaggtggctatggggtggggaaccgccaattataatctacaatctcttttgctaactagcattccactggtcagggaagttccagacagctgctggggacagccaagctttcctctcggcccagcacgcagctgttcaggaagggatgctctcttcctttgagcccttccccctaccctccattctctgcctcctctatatcttgactcttctctctgctcctgatggtaccatgcacagttgatattttctgtcaatttaatcccattttaggtggtatttcatattttcctaccctcactaaaacctccttaaacattcagtaaactatattttcataacgggttttcacgtccagcctgaatcactccctgaccacccaagtaagctcgttgacttacttttccatctttgtatgctcagtgcaaaacataggtccaggtttataataggtgctcaatacataatagtagatgaaataaatgacctaccttttctgacacatgggaatgcctttctatattcttatttttggtagtgaagtttctgataaaacgtatccagggaaacacgttgctaatagaagtatcgcacacgttaggcataaaagctgtacccttttttaagtgccacagaggactaataactgttagtttgcaatcacagactacaaaagaaatgattgcatgaatagctgagattccaggtgttaattcaatagcaaaaaaatgtgtgtgtccttgtactttagtttctgatggttaggagctgatgtgtacttgcttttgaattcactaaaatcagattcaagaccttctataaatctgtagactcaaaggaatggaaaatgcccccaaaggtcacctggcacaaaccctgcctttaggcagaacaagatataaaactccttgtcgactgtctatcctttaaaaacctgtctcaaggagaatatttttaagtattttctttttctttaacctcggaaacgcttttcctgagggtcagtccttatggctccattacacatgatgaaaaattctcccctgccatattgtaagatcatttccatttgctctgtcctcagcagagcaggaaaacattggtcagcttcctccgtatcatgtcccttaatacacttaataaatccgccctgagctcccttttcctcagacttcataaatccaattcctcaagccgatcctcacagatcagttttgcaaccctttaatcattttaataatttttgtcactctcagttgaatcatttccaatttatctgtagcctactttttttccccctcaattaaacaccatggtaatgcaaaacggaccagagctaagaataggaaagtttcacagttcttgagtgttataattcctttttttttttttggagatggagtttcactcttgttgccgagactggagtgcaatggtgcgctcttggctcaccacaacctctgcctcccaggttcaagtgattctcccgcctcagcctcccaagtagctgggattacaggcatgcgccaccatgcccagctaattttgtatttttagtagagacagggtttctccatgttggtcaggctagtctcgaactcctgacctcaggtgatccgccagtcttggcctcccaaagtgctgggattacaggcgtgagccaccatgtctggccgggtgttatgattctatgacaacatcacagaaacattttggtatctaaagacttttcttttttttttttttaaattagaagagcaccagaaaactttttcacctcctgttcttgggcaacactaccttccagatctttctcagcagtgcttgagaaaaagcacttagtcctagtgttagctgtttattcatcctcgcagagagaaaatgatccattctgagatcaaaaagaatggcaaagcctcgaaaaagagaggtaagaaactcaaggcttttagagccagggaggagcctggagaatagggggcagccaggtgggcatggtggcagattggaagcacctgtgctgtttaaaggaggggatggcctttcatgttaagctgatttttttcttcacatgagaatgcccatctagtgcaccaggagcttcctttggggggaaaaaaagaaaaaaaggctgggcacggtggcttacacctgtaatctcaacacttggtgagaggccgaggagggtggatcacaagtttaggagttcgagaccagcctgaccaacatggtgaaaccccgtctttactaaaaatacaaaaattagctgtgtgtggtggtgcgcgcctgtaatcccagctactcaggaggctgaagcaggagaattgcttgaacccaggaggcagaggttgcagtgagccgagattgtgccactgtactccagcctgggtgacagagtgagactccatctcaaaaaaaaaaaaaaaaaaaaaaaagttaagccacaaatcgatattttaaatttaaatataaaatggcttaattaatccattgtgcagctcaaccctgtgtgggctcaaaaaggtgcaagcaaggttttgcccatgggctcctgcattcatgcccttgccaggaggctaatcctctaccgtccttatgatttctataagaaatttctgaagacatatgcatcgttgagaggcatgttctttacacatgaacacttttataaaattgtgttttaagaggagattttaaagggcaggaacctaggctctttactctctaatgatgaaattccagatgcagtggctactaaaaatgacacaaatttgtggagatgaaccttcttgatgctttgtaataactcaaccatcacaggatgtgcggtatcatgaagcgtgattgtccctgagatcgccagtgaggcatcgtgaagtgtgactgtccctgaggtcgccagtgaggcatcgtgaagtgtgactgtccctgaggtcgccagtgaggcatcgtgaagtgtgactgtccctgagatccccacatcaagttgttgtttccagttaatctgagaccaacgcgaagcccattgaagaaatgcacccacttgtgcttagtattctaattttcaaacccagcaggttcaattcccttacaaaggttggtctaggatagagttctgggtatagaaaggcaatttaaccaaaatgctttaccctaattacacagcaaagctatttgcataagtaaccagtctgggtattaagagacccaagagagtcaatgttactccagcagaagttatgtttttgctaaccttcaagaaaataatagcaagtcaagacttccaatgttctatttgtaaaagcaaatgatagaggatataatcctttatcatttgaatgaaatatgttggaaagagattggtctccattggaagtgggctgaaaatggccctcctttcccctgtggccatttttgcaggagagggtgttgaccgtattgagcgtggataagggaaatagtttttgttatatcaaaagaagccagtccagacatgattttcttcttccaatatggaagatgctatttttaaagaggccactgatcttttgtttgctatagaaaatgaagtaatctcttagggtaatggactcaaactataacaaaggacaggttatcttaaaatttgataagacatttctaacaggtaaacaatgacatcgtttactaggaagaaaaataaatgttctttgtggagatttttaaaaatagacaaaacaatcacctgaagagattggcctatgaggcttaaatcacggcactgcaggagcagttcaatttgtcagattggaaatatgatgtaagtttaaaaaatagaggaaaataaacacaatctagattgctgctacatatatagttcagatgatttaaacttttgcaacaaaatgatgcttggtatttatcagttttcccttccaatagaatataaaccgcacgaggcctaagactgtgatgtcaactggaaacaaatcccttcatttctagactcctggggaattggcaataaggataaagaaaataagtattatgaaggatgagcaaaataataatgcatctttcatggactccacagccatatctgacaccgttatttctgtgaaaggttttagcccatgacaattgactggacacgttaggaattatggtcatactgtcaccatctattcaagaacacccagccctcatgacatgagcaaataacagcactgacctgcctaagtgaccagacaatcctttaaaggagtatcactaaattgcagcattccaaggccaggggtcaagatgaaaaagaacgatccagactgcaagttgccaggttactgcagaatgaaagtggcagatgggttgatcttaggaaaaaaaaaaaaatctgctaactggtgcagaaaacattagtctgggagaagaatatctcactttagcggagacagctcccgcagttccattcattacgatccgcgggaaggctagacttgctgtgagggttcagccaaggctcaggcccacgtttccccctaacacagacacacatgtgcacacacacctacattgttgtcactgtatgcagaatctcctgccaagagccaaagtgacaaaaattatacagtagcttgatgggaataagaacacaagtgtacctaatctattcaatgtaagtctgaaaatggaaagaggtctacaaagaacagtattactaaaacagtaacagaggtggtttcatttttattagtaaaaaatgctctaaagcctctgactgctgcaaatatgataaaacagcacatcccaagctcagaaaaatggtttaaaacaactctaaggaaatgacccccccctgaaaatcaaatggaagtggaaacacacttggccaaaaagggaggctctggtgcataagacaatataataaaattatagggaaacaatatgatagaaatgaatctgatgaagtgtattgctattgtaagtaaattcatgcggagaagtattgaacaaaccacaagaagggacacctcgttggtagggatgacacctttgacgtgctaacaactgctcatttctcacggtcaacagagcgggcttcctttcaggtcaccatattgaacacacctggcttggactgaaattcctggtgaattggtatacaaggtttgtcattaactctgcacccaaaataaccacacaaccaagaggaagctctttctaccttttaatgttgtgagatgattgttctacacgaggagaaaacaatcacgtgtgactatgtagagcaaacgcggagaggcaagtgcccctgactcttacttgccgtcctcctggcctccctggtgcacacagctatgggggctggaagttagcataattacttccaattaaattaaggtggcacagctttttcccctttctctttgaatagctgtaggcttaagaaacaatatccgtgctgatgatattccataacaatatggtttcatcaatactgctaggtgtaagaactttgggagtcatacattaacctgccttcctcttgcctctcagagaaatgcccatctggcctccacagaaccactcttgccacggtttcgatttctcaggtcaggaccaggacaagttccactcacttaggaaagcagatgtttaggagtttcctatttggcgactcatgaaaatgatagactggtttctagaaataaaaatttggctgcctcttaagctattacattctcaaactgtgacgggatattcccatttgagcttaaagatacatgttttgtttgtttgcttgctttgttttttgagatggggtctcgctctgtcacccaggctggagtgcagtggtgcgatctcagcacactgcaacctccgccccccgggttcaagtgattctcctgcctcagcctcccgggtagctgggactacaggtgcatgccaccacgcttggctaattttttttatttttagtagagacgggatttcaccatgttagccaggatggtctcgatctcctgacctcgttcgtgatctgcccgcctcagtctcccagagtgctgggattacagcacatttttttttttttttgaaagagccctttctgctttttttcatttgtttacaagataaatttttgaaggtaaatgtgggcaaggaggtaaacaaactgagccactacatgaaggaacccgaagttggactccttctaggaggtgattttctacctgagcatgctgtacgggccttgctgctgctgttgtttttaacttaagaatgactttcccctgtaagacatctcatgagaaggcggggaaagcactactttacaacgagcatgggaggtgggcttatctcccagatccatcactgaaagctgggctatcttggggaaattatttaactttcctgaccttttgttccctcctctataaaatggtgacaaatagaataccttcctgacagggttgtagagaggactaattgagacaaccaacgtgccagcattttgggaatcattaaggtctatgaaaagttggtggttgtgtaactgtaacagctgtattttaggaccccaggaattacgatcttctcaaagcagaaatgtatttctttgtaaccttattatctagtatatttcctggtgcaactaggatctcaggaactgtaaataaacaatagatttaaagaacaaatgactgaatgaatgagagaaccaaagaaaaaggagtagagagagtggaaaaaaacaaaacaaaaccccagagtccttgctttctcaagatttctgcaaatgaaagatatttatttatccaactgggcaaggactctttaggcaggttgcacagacaggagttggatggtgaatgtggtcatgatcttgagaaacaaaccgggtctgagctgcaggacagggtcagaccatataaggctgggactgggactctgaacagttttttgggggtaaagttttattttgaggagtgataggggttatggggaaaaagggtgaagaaggcaaggttttaaaacagaataaaaccaaggccagctattttgaggatgagcttgaacagatctgaacgcgagggacaaggtgacaaaaagcaagagagggttaaggatctgcgtctgtgactcacgctggcttaggagggaggtgatgggtggggaggaaactggagttgggggatagccgtttgtcctgatgattagaggctggtatctgggacctcattgtaaagagactaggtccagggaaaggggacccagtgactaggggctgaaagaaaactttgttgctgtgggaaccaggagaccagaagggctctggttccaggaggactgcggggaggccaggaacccaccccttgaaaactgcactaggaagtccagagcggcaagctccttagtgctgccgtcatggtgcctactacggagtcctctgggttcctctcccctgaagccaagggtgtcccctggtctcaagcagcactgaactttgaggtggcagttgagaggcccaattgttagttaaagatgggccagggggaatatcttcatcacaagatgcataaaagcgactctatacatgtcttatttcctttaaaaagcatgaggccaacgtgcagtgtcttccaggctgttttctaaattgtgccatgaaagggcacattcacactactgacatgtcctgcttttattgttacaccttcctccaactgcatctactgaacatctattatatgcatagtaccaacgagaaatcagcatccaactgttttcccccttcctgttatctgaaaacacagaacagcgttagataatttaaaatgaaaacagcaaaagtgaccaataataacaccgtattaacctggttaagttttctggattctggatttcttgtgagtttttatccatgtacatatatttttgtaatattgtactcatagtaaatgtaattttgtggagcttattcttatatgactacactgcctttagagatgaatcttaattttcaggcatttggttgtgggatgcttaggctatgagaagctggatctcaacatttaaagcaggatcatttaaaatgaggagtcaattgtgttacttcacatgtgtttcatttgaaacagtatatcgttatgctactatgataactacagcaaatcctccttaggactgatttaagcattgaataaataaagttaaaattgagtacactgccattttcagtgcttcttgacttctacacacttatcaactactacaaatctgatggcatccactttccagtgggttagctttcacctcgacaggtctcaaggttcttcttatgggattttagtccatggcaatcaccaccatttgagcacagtcacctagtatagctggatatttaaagaaaagaaaaaaaagagaagctaatggcttttcacacatgcactgaaaaaaattaataacctgataatttctggcaaaggagaaaattttttttccttataagactgcaaagttcaacattatgtgatttatctcagtgacctgtaagtagtgcctataattattaaaaataaccatcaagctggcttttaagaagcttcattatggtactgctaatacaatgcccaactccattacttttttctatataaccttaaaacagagccagttcattcctagtgtttccaaagtgttactttaagaagaaaagtgggccaggcgcagtggctcacgcctgtaatcccagcactttgggaggctgaggtgggtgggtcacctgaggccaggagtttgagaccagcctgtccgacatggtgaaaccccatctctacttaaaaaacaaaaacaaaaacaatccgcaaaaattagctgggtgtgatggcgggtgcctgtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagactggtggatcacctgagattaggagttcgagaccagcctggccaacgtggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaagaaagaaaaaagaaaagtacaggaacatgactcttaaataagccaccatttcagtggatgcatttattgaattgatgctttcagtaagttgtttctcattgtatgcatcatgttaaaagttgtatttaatccacaggtttaatgattaatttcttccagttagggtaaaaatatagtattatagagtttatagtaatagtgttgatttcaacttacgatggagtaaacaggttttgtaattgccttgggaaagccagaacagaaaaagtaattctatcagcaacatggaagcaaaatgagtagatgacttcttttatctgggaagcacattttcaatcacgagttcatgattgacaagtgtgagtttgtttggctggggcagggttccgtgtgactgacctatctttttaggttcattcgtgttgaccaatctttatggatctgggagcagtaagtcaacctagaatcaccaaatttggctacttatatggtgacatcacagcgcaccaaaacgtacatcaaaaccactgaatctgttggtttcatggggttctgcttgggtaaggacccagccacacagttataagatgaaatcaagagttgaggtgctaggccgggcgtggtggctcacacctgtaatcccagcactttgggaggccaaagcaggcagatcacaaggtcaggagatcaagaccatcctggctaacacggtgaaaccctgtctctactaaaaatacaaaaaattagccgggcatggtggcggtcgcctgtagtcccagctactcaggaggctgaggcaggagaatggtgtgaacctggaaggcggagcttgcagtgagccgagatcgcgtcactgcactccagcctgggtgacagagtgagactctatctcaaaaaaaaaaaaaaaaaaaaaaaaaagagttgaggtggtagttgcacaaacctacctgtgataagtagagctatacgcatacactgtagcaaagtcaatttcctggttttggtactgtactctagctatgcaagaggtagccatttggaaaaagctggtgaagggtacctgggacctttctgtgctatgtttacaacttcctgtgtatccataactatttcaaaataaaaagtaaagcacacatgaaatcaagaggactattatttcctcggggagactggcagaagttggctgcacagtggcttcaagctggagggagatttggcttctatgagggcatgtgcgagtctagctctccagataccttagatgaaggccactggcctggggatggggccgggggcactcactgcctccctcactggcagctggacagtgactccacaccatggggccggggaggtggcaacataggtgcatgagagggggactgcccccaccctgcatatctgctggcgctgaaattctctcaggacagctcagccctgctttccagaagatgagaggacttcacaaagctgcccactgccactgagcaaacagaatgtcctgtgcagggaaagcagcagaagggcccagaaacagccagtagccaggcgtggtggtgggcgcctgtagtcccagctacttgggaggctgggcagcagcctgggcagcaaggtcaagtgcaggctgctgtggcactgggcgctgcccctggctgtgcaatcccagggctctgggtgagagctgaaccgaggctcacatctgcccttgctgggttccaccaccttctggcaaagagcattattggttcaatgttaatgccacggcctccccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaagagaatctccctctgtccacagaaatgcctgagcatggaactctgggaaaactgcactcgtgtccagatgcaagtaaatgataaactcctcgagacttcagacagagagcatagacatttatagcgcaatgtacttgtaacacccagagacaataagccctcttgccaagtctttgctttgggagtataggctaattgagggagattgcactgttagtgaaaaaagtggaatgtttaataccaagtagggagggggtctgcctttccaagctggggaagtagggaggagagaggaggtttgtgtggatggtgctgttcaaggttcccctctgaatcctgctcacctttaaatacctctggcaggcctgcataaagggcccatttcccttcctcatctagtcgaaaataccagcaggattgctctgaatgaggagacaggagcctccattaaaatgcagacgccaattactctgcaggatgggcactaagcttatcctccagacttttactggtctagcaatttgattagtatcagggtagtaacatatctccctccaaagcgtggagagctcagaggggagggatatagtgaaagacaggtggattcagcatgatcagatctggatgggctgagcccaaggagaatgtgggctggagatcaggaataggcaggtgtgatggagaacttacaagggtaccatgaaagggaagagatataaacaagcaaaaagatatgagcttatctgttacgtatttctttacaattttacataaggttagtccttatggtgtactagaataatttccatttatgtgcaaggtaagatcatttttacatttagccatcatcttcattgacgatgcaattcttagagtaccttagagaatctagaggaaatagagtggtggccttcagcgcattcctccatcttattctcctgcccacacccaggaccagaagaagaacacattgtcattcagtctgaaaccacctcaaagaagcagggtttggtaacaattagaaggtgaaagagaaaaatcacctaagctgatctaatttctttctaaagggaggaagtgtattaattgagggtggggaggaggaatagcttgaggaaacttgtgtttccaagaaacagcctcaccagtagagattgtctgtggtttgcctgttcttgctgtaggcaggtgcacagttgatggaaggccatgcttatgagtcttcgatgacaaatgatgggtacatgatgggttgaaactctcctgagctttcttcactttcttggcttctctctatgctcaaatctctctatgcattttttttttttttttgagaaagagtcttgctctgtcgtccaggctggagtacaatggcgtgatctcagctcactgcaacctctgcctcctgagttcaagtaattctcctgcctcagtctcctaagtagctgggattacaggtggccatcaccaggcccggctaattttttttgtatttttagtagagatggggtttcaccatgttggccaggctcatctcaaactcttgacctcaggtgatccacccacctcggcctttcaaagtgctgggattacaggagtgaacccctgtgctcagccaatagttaattctttattttgaaatattctaggaggaggaaaaaaaaatctgaccatatccaaaggttagtagttaatagctaaatatcaacaaagaggatacagctaaagattccctaaagtttgagtcctgggtcttatttaattggtgacttgaataacatatttgaaagtaggctcatgaatctacagatgaatcttcaaaatacctttattatgataaaagagaaatccaatgctgatgagtaggcttgacttatgatgagaaagctgttcttccaaatcaaaatgtagtgaagacattttacataaagacacaagaaactccgcatagtcatctttgtatcacagatgcttacctagtatctgacatagggtcaatacccataaatgcttcttgaaatcagggttcagttagacacaaagctacagagcttaattaaacatataacaagatcattggtcattattacgaataaactcatgtttactggcctcttctcccgtatgtgaagagggatttcttattaatcccgggtcttaaatgagtttgtcctcagcaggatctcaaagtcataagagagctacaaagattgacaattattagacagtgtcagagttggaggtgagtcttaggttgggttgatgaagcaggagacttctagttctcaagaaaatgaagaataagagagtgacaaacagtgaccatatatgagcaacgtattacccatttgcctacatatattcattttgcactatatggaattacatatttttcatttccaagaatttgttgctcatccattgttgcaggtctgacaaattaccgaaagcaaagcataaaattaggatagaaatcccattgtgttaaagttccatggaaattatgcagaaactcaactgcacagaagagtgcattaaagatacagtggttgccctggggaagcttgctttcttcttaagtattaaacatgtcattttcatatttgagcaaaaacctgaataaactctgccctcaaagaaatgaaagataaccactgactgtgcacttcatataagcttcactgctacattttaaagtatcctgaatagtcccatgatgttaagatagcaacactttattatacacattactaacgtggcaagctctgaaggtcagggagtggctggctggtcttcagcttgacccatttgggaggtccattttcatctttggattatctggcctctcagtttgattactggggccataaacagctttcccgtgagagctgaggtgaacatttcttgctcattaggcctcttccagacaagcctcccttgcatgcaatgaatatgcacttgatgcccagtgaacatgcacttgatactcaatcattgttcttgacttgacattctggttgattatcagacatgtaatccatcagaacagagatgcaaactgaggatcttgaattttgttagtttcattccagagaaagctctgttggggctgggaggggtggcagaacggatgtggacggcgaatattgatgcggtgtgtgtgtatataatgttctcctgggagaggtgtttcttaaaaagccgagttggttttcaacgtgatatttaaccgaatgctgccaaattgtgctacctccccagcacgttaaaaaaatccattaataaagtgtttgttgttgtcagaatgcctattccaaagcttgggctgtgtgaagggctgactccccacaagagaccgatgacaggcgagggaggtagaggagagggctgaagatggatatgtgctgccttgctgacaagtggtgaggacaagcgaggcgatggatcagtagaattttccattaaatcaagaaaaacacaacttgccccccaacatcacctctgatggtttcttagaccagctgcttctctgactccctactgaggaacaaattgctttcctggcgggacatttggacactcctgcattaatagatatggatcccagcatgccaagccaagcaagaaggcaatttaatatgagcaacactgtcatctcaatttaggacaacagctagaatgccctacagggcactgcaacagcttcgagaagtacatgacagaagacattctcactgtcttgaggctagagaaagctggtgtttctagtaaacagtcagaccaaggataatagaaaatgtaatgcaaagatgacagcagcattgtcctatctgtgaacatcagtttcaattcatgtgtctttcccttccgtagtgaacggaggtcctgtgtagggtacttcccttctatctcaatcccatcacaaagacacaaacaaaaagcccagtgacatcgtatcaataaagaaataggtaacattagatgacagatgttgtatacctatgtttgaggaaggtcaaagtaagaggtaacttcacgtttgcatgttcaaacttacttatctatctttgatgctatgcaagacaaaataaatggaagccctttaaatttccacctcctaacactagcctgtatgcaagaaaaatatattcttgctttttaaaaaaaaactctaaatgcattatgttttggtacatactttaatattagtttctattttatttttccataataaagacatggttgaatccagtgtatctattatgctaagataatttatgctaggataatatttttgataggaattctcataacaaatcagcttcatgtaccaattacaaaattgggagataactaaatttttataaaacgttttggcaatatctactgatacatcagtttattttaagtcagtgtggtttcttatcaatcatattgccagggattcatacataaattgagaataaaatatgttcacatgtaacaaaaatacaaatgtatctcctgttagagtctctctagatagagacagaaaaagtgacacagtagattcacacttgagtttgctcacagacaatggcgattcatatcaattgcaatgcttttcatggtgtcattttgcattagacacaaaatcgcaaaataactcaattggtcattaccatgaacacttcaccatggaactagctatgtgacagctcataaggctatcattattatgttgtcaaaagtccctattgctaacatttactgtatgatgaaaaaggtctttcccctatctcatgtgtgtttgatgaggtgacattgttttataaatcaatttcatggaaagtaagtatttatcttaaaatggtatccttttatctttctctgttcctcctcttctccctcctgttactgtttttcttcttcttttgcaaaacatttgaacacagaagcaaaccatttttcaaaataccatctgagaaacccatcaagcatggatagcacctgtgaccagaggagagcctctcagcaagagagagactgggaataacatttcccgtatcacttgggaagtaagaggaaaaaaatgaacacaattcaatccatgaattaaaaaaattttttttcctatccagatagttctcattattttttcattaaatattttttaacataaaaatcccttgtttccactattttctatttgtgaaaaggcaagaaaataataccagctttctgtgcatagatctatcacagcacttccaaaaggatgttggaattattttagatcgtggactccctgagcagcaagggtggtccagtcttgtatttccagcacccatgaaaaatgactccatataatattgggcagaagtgctctgaatgaaatgctcccaaatagaaaaaaattgttttgtgtatctataggaagatatttcagaattatattttatttttttatttttccagagacagggtctcactctgttgcccaggctggagtgcaatggcatgaacatagctcactgtagtctcgaactcctgggctcaagtgatcctcttgcctcagtctcccaagtagctagaactacggctgcatgcccctgtgctcagctaattttttttagtatatttggtagaaacggggcctcactatgctgcccaggctcaaaactatctttagactcaacaatagttaaaaccaaaaatagtttaaattgaaggttttgaattccagagggattatgcttttcggagctgaatttcctcaaacaaccgtaacctcatctgcttgcatagcatataatatttatcaaatactaaacaaaaaatggtgaatctggaggtgaagagatatttctgcaaaggagtcttgatgattaaaagttttcaaaattataccttcacctcttatcagtgcacaacatcgtaagagtttggagggagacactcatctgctttccttcccaatgagtaggtgtacgcaggacggagcctgtcagaagagcagggctggctgctgtccttgcatccgtttgatgtaggagatcacaggaaacaatgtgaaattctgcagcctggttttaaaatttcttacatcttttacacatttcaaaacatcaaatatgtttgttgtagcttgttcttacctctattctgcctaagcaaatgatatttcatctcttaatgtgaaaataagatttttgagttgacacattcattcattttctaaaaggtgtgtgtgtgtgtgtgtgtgtatgtgtgtgtgagtagggttctgtgtgagatggacgggtgaagccataaggatatatagtataaagccatcctttataaaacaggacaacaaatcttacactaaaaatttgctctgtagagttgcaagcctcagaaagtttaggagtgtcacctgtcctgttcctgggcctggagatgagggtccacctctcccaggtcctgaggactttcctcctggagcctagcctgccagtgagtaggctgctctgatctcttctccctgcactccaacatcttgctttcagctttgccctctaaatactggaataaaagggccaacaggtcagggatattgggagcaggagaactgtggtgctgcatgaatttaagggatgtttttattataagatcagagaaggaaaaatgatcagaaagcaaagagaggaaaagtttagtttatgagaaggctgtaggaggcagttcccggagcctaagtattaaaatatgaacagagacaagagaacctacctgcacttagtatccctgtacttgggatctttgaaggctatactattttaaaaaattattctattcagcgcattgcatcagaaatgcttctatgttaatctggaaataggtgttctaattatagatgctaaaaatgttctgtatactacttggctatagaatagcctacagatataataaaaaataattatttaaagtaatttttggaaaacaacccaataacttagataatgttattaatatgggtatcaaatattttaaatctaattataccaatgtctcaaatatataacaaatataacagaaaagattaactgaaagataggtttaagttgcctgtaacccaaatctgtgtatataagcaatttagtattgtgtatcttctaaagaccactgcttgaatacaattaaatgatcactcacatataatagtgggctgataaaccagctcttttccaaccttcctaaaaaaaaaggtcagtcccataaatactctcatcacagtcagtttcaagctgccaacatgaagttgctgaacatggagctggaaaaagatgtgcataactggctcctgtgaacctggtacagctggctccagcctccagtagacactcatgtgttcagacacatgcatgtgcgtgcacacaaacacacctgttcaacagattacagttgcttattgtattgtacttgagtattgaataattgcttcttgcttactttgaaaagtacctaagctacaacaatgggcaaaaagtttctcgaatgcacacaaactaaaatattaagtgatattttcctattgtcttcttttttgttgtcctgtcttgctaattctttcttgtttacatgctataaccattagaagctctgctaacatcttaaataaaatagaaatattaaaatatatatataaatataagtaatataaataaatataatgaaataaaatctcaaagcatcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaacacgataaaatacatacaaatttattacatacatatgcatgagagtccctcaaaatataaggctcaaagaaggggtaggtaattggagtttatatagaatccctgggctacagaaaggaatagaggtttggggtctctggctgggaggtggtgacaggttatggaaaggtgaggggaggaaatgtatgatgaacaaaggctatcttgttataccgatagaaagcctcaggagtagtaaaagttgtttcagtgcatctctcagaagaatctgtgatcacctgtgacagagtctgtctgggtaaggtatcacctccaatcttacctcctgtgataagatcttctctgtttcatgagattcctatgacaattattttcctttatagatatagatttcttttacaaaagaacagctattcagaggcacttctgtgtctgcaacttctcagaataaccagctcaaaatatgccaaagaagtacattctggggtggcatgttctggtctcctaccatcatattttggggtgaagtgtcttgagccccaacggcatcaagtatgaacttggagccagggctttggtgtacatttctgtaatttgtgcttcacacaaacaattccacctataaggccagaagggctgggaaacagggcatttccctccctgaaccttacaacctgctggatgctatgcccacatgagggaggggtgccttctaattcacagcaagatgccttctgctaccaagtgctgtggcctctctctgcctgaggggtggagtgaggaacatctgcccatgggtagtagcaccttgtaaaatctaaaaggtggggaggcaaagaggacacgcactgcatcttcttcccttgcacttccttttactactagaatgagagtttcctctttccgtgatgctctaatattcctagtcaggccaagctattgctaatcagaacattctccggctctccagtcttctttattagactggcctctacagggctggagtctcttttctgacagtgccactgaatcagctgtctgaagaacccttgcgggagactgatggaccttcacagacaccgtttctctaggtcagctcagtttaccccaaggccacaggcattactgcctcctttaacacagcactgcttttaaacatttctttccccccacttagtccccagagacttagagttaacttgaataaattcccctaatctgagattgaaaagacagaaaagatagaaatcttttcttccttcaaaatacttaacatatatttgtgggacagaagaatttccatagatataatatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagctacaaatatctcctgatatgttaaagaaacagagtcttccatagctgtagtgggtgcacagctgtgggaacgcaatgtggcctctcatacactccaggagctgttcctccaccccttccatgaaggaaaggtgatgccttaacccttttggagaggtgagcagtcttgaagccctcaataatatccaccagcaccccagtgaaaatgggaaataagacaggaacttggagaactcccattgagaaaagatcctagaaatcacagcagagtggcagggtctttctcaactgtgtccaagtggaaatggggttgtgtacaaatagggccccctcatataacacgcaactgactccagggcacacccatacttttaacgtctgattgctttcaagaatgctgtgaaaagttgttgcgagatacatgggattgagacttctgcagtaaagggttgaggttagacactgagtaacttcttgtcagtaaaaggaattaaacactgcctcaggagatggtataattatctcctggggaggtgactttttgtcttgaatgattaggtgaagtccaatgagaatctaagaggctggatgaaaattcttggaaattaagccacaactgaaaaaaggagccaaataaataaggccttctctggggcctcataccgtgtaccaagggtcgaagaagtaaagtttgcctgactcatgattctagcttagaaggcaggaatcctgctttgttttatttgaattattgcattgatattcacaacaacagtcttgtttgaatatcttaatttaggagtctgctacttaaaacagctgtcttatgtctatgagatatacgagccacaaccacagactctacgctgcgttcctctccctagtcaccgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgcaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggcaactcagtttaagtgaggctgttttggaagaagctgtcctacatataagttgtcttctgcaaaataagacacaaaaatagttttgaaatcaaaaaagatttataaacattattggtacaactgatttttgtctctggctggaaaatttttcatgggttacacattctttcatatatttctcacatttgagaagtggagatttaattgcttacattttgatgatgaagaaaaataccacttgacacaaattaatgtcaatccttgagggaccagttccttttccacggcatatataataaaataacacaggaacattaatctactttgtagagtagtgaaacttattgagcatgttataaaaacaacagagcagcaaaagcattttacttaagaagcatttaaaaaaaaaaccctcattcatttcacaccactctgatgttttagccaacagttttttcactgggccgtggctgtgcacacgggcttcttgccatcacttaaatggacacttctcaaactctccctcacaggtgttcctggacagcacaggaaagagaacaaagagaacaaaaactacttggattgtctggaggtcatagtccaaaggaagggttgtaaatttagacattttttgaagattcacgtgtttggttcaatataaaagtatcattccccacccagacctgtcccagtgtctagggaaatgcaccttctcctgtgacattgcatatcatcttccatatcaggtaccctggtttgaaaaatcatacttttagaagaaattgccctttccattttcttaactgctctggagaccagcaggaattggagcagcctcattccgtgtcgaagaagacctatacggcttgcttctttttttctttttttcttttttttttttgagatggagtttcactcttgttgcccaggctggagtgcaatggcatgatctcggctcaccgcaacctccacctcccaggttcaagcgcttctcctgcctagcctcccaagtagctgggattacaggcatttaccaccacgcctggctaatttttttctatttttagtggagacggggtttctctatgttggtcaggccagtctcgaactcctgacctcaggtgatccgcccgtattggcctcccaaagtgctgggattacaggcgtgagccaccacacctggcccaaggcttgcttcttttaagagaaaaaggctgtcatgctgctctacttcagagaacagaccaatttttagagagcttcaacaatttctttctaatgataattcaaatctttaccaaaatcctaacacatcaaatttcagtttcatattttcaactacctacgggatattttattgcttcaaacagaacatagcactccaccatctgataataatgtttattttacctgaatgcaagttccgtaagttccatcatttgcccagccttaataataattgtgcaaggccgggcgcggtggctcacgcctgtaatcccagcattttgggaggctgaggcgggcagatcacgaggtcaggagatcgagaccatcctggctaacatggtgaaaccccgtctctactaaaaatacaaaaaattagccgggtatggtggcgggcgcctgtagtcccagctactcgggaggctgagggaggagaatggcgtgaacccgggaggcagagcttgcagtgagccgagatcatgccactgcactccagcctggatgacagagcgagactccgtctcaaaaaaaaaaaaaaaaattaattgtgcgaacgccaccccctaccctcgcccagcaacacagcaacattgctgaggaaactgatgcactcccacattttaatgacccagtgttggaagaagtcaactaaatgagttaaaagtgtcccaaggtaggtggcccagtaagaccatcccaaagaaaggaacctgggcagaatccaaaataggctcaaaggagaagattttctctttagggggcttgtacgtgtgagtggacatagatatatacgctgcaaacgtgtaggggatatttaggagcactgtccctgctgctctagggcacctattccttggaaagagtcagggtgctctgaaaaaaatcatgtcagtcttaccagcaagggaattgtaaacctgaatatcagacatgcgggtggattacctgcgtctattatccaggcttgggaaatggaggtgctcagggatgagaaggattagattataaaagaacagctttgaggaatgttttggaactgttacaatggatcccacttttagggatacatagaaaaagtctttgcaaataccagagatacaggcactacaaggaaattagatagatgccaaaagcatttaataaagaaggagtttggggtaaaaatttgcaaatcttcaccatcctactcttccctgaaacaaaaaactaatttcaatttaaaattttcactatgattagttctattaaaaatcaatcaatctatccatcctatctctgtcttgcactctctctctctctctctctctctctatatatatatatatatatatatataatctatctatgtgtctataagtacaagatgcttcttgcagaaaaatttgcctagagactgtgatttgtgtaaaactaactggattaaaattaaaattcgcaagttttagggttcacttaagcaaaaaaataactttttcattggtaaaatggtaaatttatttctggatctagtttgtgaagcaggagtgtgtatatggctgtgtgtgtatgagtgtgggtgtatgtatgtagtgtgtgtgtgtgagtgtgtgtgtctgagtctggacccagctccctactcaggagtttactccatactctatctcttccagagtaggctgtgattcccagtgtactaatgttaaatgttccagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatggctggaatgtcatggtcagaaggtctttcctgtctttcactttttcatgttcactggtgcatgcacgtggatgctgggatatctgagtcaagaagggtggctgtcactgtccaccctttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtataaatattctatagtgtaccatattagctattaaacattatacagagagtggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagcctgtaaaatcgacctgcagacacaaacaagcatgctggaagcttgcacaggtacatgctggcagttgtgcccgtaggaatatactacctgggactagccatgttcaaaatggcggctccatcttctctttttgccagccacgtgtccagtaaggagcagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaagcctgcctataaaatctgctgggatctgccaccttaaccctttttttcagacatctctctctcttgcaaggagctgccctcctctctcctttcttccgcctgttaaactttccactccttaacccacccacgtgtctgtgtacttaattttcttggcgtgagataaggaaccctggggatttaccctagactacgatgctgcttcactagtaggaagagaaaagataaacagcgattcctgttttataaggtaggaaggctgtatattcacacgacactcgccgtcacagtggtctctgtgacttcagtgaaccccctttccacctgtcctcctcgccctcacactagattactttttccaaaagatctgatcatgtcacttcccctggaagcccttgcctggcctccattgtctgcaggatgaagtactgaatccttaacccacagggccagactccctttccctgtcctgctcttgatcaggcaccatgagcccacgactcctctccgtcggctaatcattcctccctggccgtgttctctgcagctgcctagctttctgtcccttcactctgttccagaatcttctgcctgaaatatttcagtcaccacttccaggtcaaatttctccatccctcagtgcgcttaatgaagctccccattcttgattccaaaccttttcctttctcactgcatcattcatgattgatacaacgatgagtgtgctgaatgcaggcatcgttgctgaggatacaaaaatgaatagaaggcagctcctgctcaccccaccagcggccccacagcagctccacgtgtgggcaagtggtatgcacacgagcaatgtgatacacgtgactatgagatgtgttcaaggtgatgcggaaactgggtacgaaggcccttaagtatcctggatttctgtgggacattcccctgcacagttacgtgttgccatgcggctatgctgtttcgcatagacatgtcttgtcttcccattagatgacgtgtttcttcagcacagtggctgtgacatcacctctgtgtgcctgtagcatctagcagagagccacatacatgctggataaccaattcatgcatgtagaataaacaattttcccctacaagtattactgatttattttaaatataagaaagaatatactgaattttcccccttggtgcatgtttcttatgagtacagcttagttgctaaaaacagcgtgatttctagtgattgcggtagaagaataaaagctaaaactcctaggacttctgttagaaatgtaaatcagaagctgatattacttcaagtgctacgtgaaataccacattcaatttgtaactccaaaagctttagtctgtggtacatgtggttctacatggtttagtagtgcctttgtatgtgacatgagaacaaaataatcagcaggtgtaaatgtcaatcgaactagagaattttctagaattgtacctctgctttcagtttatggcactactgaatgcaaactctatttatctgcacaacttcagaaggttattgtggcaacaccttttaatagaaggggcgaatacaattttacgggtattattgagagttagaggtctaatttctcatgcctgggaatacggaaagtgaaaaatatatattgttacaaaaaaagataaccaaggaaatactcaattctgttagaaataaaaaagaagtagtttcatgccagaagacttttttcttttcctgcatgaaaatatgaaactctgagactgcacacaagtgaatggtatttgagtaatgataaaaggagacagaaaagacaccagatgaggcagaggctgacatttgtccgctcatcatccatttgcccttttcttcataggaacagtttctagctgggcacatcgcaccccgaatacagatatttcccaactgctttgggggctggccatgtagcctcacaagtaacttttctctgtcggaatacgagtacgatgttgtgtgctacttccagatttgacctttaaagagactgggaatgtcctcttctctttcccctttgtttctggttgaaaagtggacctggggctgagccaccttgcaccatgtagatgagggcaactaaaggcttggtggagtggagcatcccagctccagacattttatgagagagagaaataaactcccatccccttaagccactgcagtcttaggaactggccacacaccacggaactaacgtcagaataatataatggagcctactacaatccatttagccagagaggaacaaaaagattttttttttttattgctgattacagttacagtggacacaaccatattatggaatataataatctggaggtgattttgtttgctactaaaacgctctcatcaaatacttcttttttttccccaatatctgcccaaagtccttagtaaatgaattcctttggtcattattaagagaaataaatgcctgtgtgcccattaagagattttgattggagaaacagaaagccccaatttaactggcttaaatagaaaggaaatgtatcatatcccatgacaggcagtccaaccatggagtggcttcagagctgatgaactcagtagggcaatgaactctagaagggcctggatcttctgaaacctgatcactagtaagggtcaagggattagcaagactggtttagactactcagaactcactactgacccggaaaatgaggtcatttcccaaactggtccacacttgaaaaaaaaaaaaaatctgttctgttagcaagagaaagggggagatggccgtcaggagggaaaccgacattttagtgtacagtctgtctgctgtgcacacagagattctaaccatgacctgatagaaacttacccctgccagctgccagccaggtgctgggggtcatgctctatcagcaagcagttctgtttgtacagggaaggtgcatagcctatagagtcggtttcatgctggctattttattcacattctgaggtagtttgtgtccctgcagatttctgattatacatcagtgacgtttaatgtgatgctcagaatattaaaagcatacccagtaagtgttttatctaaatcatgtttacaagggaagttctgtgcttttctgaggtcttgcaaaaacaatctttggtttctttagaccaagaaactaaaaatagacacagtgacatagcctccaaacagcaattttgagatcgaaaacctctgttacattaacaatgtgaagcagttcccatccatcccattacaggaagttctgggtcaatagatttagtctaacaaagatcttatctctttaatcctatctttctacttcaacttttcttattgattaagcatcttctgaactttacaacaatacaatactgcttatacaaagcccagccatgtcttcacataaaagagtttttgagaagcctactttgatttagatttctttctttccaaatagcagctatcttctgaacacatagcttttctacgtacttcctatttacatgtaaaaccatttaaatgaatggtctaaacaaggttgattaatcactgggaaatttctctttcaggacacatccattccaagctctacattctttaaaaatctagcaaataaaatttcatcttatttctgatgcaaatgactaacataagttgactggactatctcttctatttccttcagataatcagggcaagtcaaaatgcaggcttgtacaaataaagaacaatgcttcaagttcttttttttttcttttcttttttcttttttttttgagatggattcttgctctgtcgcccaggctggagtttagtggcgtgatctcggctcactgcaagctctgcctcccaggttcacaccattctcctgcctcagcctccggagtagctgggactacaggcacccgccaccatgctcggctaattttttgtgtttttagtagagacggggtttcaccatgttagcctggatggtctcgatctcctgacctcgtgatccgcccgccttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacgggaagagtgaacacagacttcctccaaattacagccctgccagtttagcactaataccttgagaggaattgggaaaaaatcgcttggcatcaaattcccagactgtccctgaactctggtcaataaccaacacggctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgacaaattacctcctagagtgcaagagtgaggcttatctgcttctgactgggttccttctcacttgtacacttcttctgatcctggttcaagaatgggcaaacagacaggcaagggttatacatttgacctgggccttacccatggccttgtagttacttgatatttttcttctccttgaaaaaaattcttaaataaattggactttaagaaatctccttcttagtctctatccacaacctcaacttcttaatggacagtggggacaaaggcctgtatggtaggcttggatagctctgccaggtgtacctcctaaggacctccaaatcttaggggaggtgggactaaaggtcaagccaggacagatcagatttgcctaggggacacttcaagtttccacttcttggtgcaaaaagaggccaaagtgagtctttgaggacttcaactggtagaatcctggggcccactgagatgccaagcggagaaggaggaaaaatggctgcatttcttggaatctcaggaaatgtgatttctacatctgttgcagatccttggagaccagtgcccatgggactggctggtctttacccaagaaaagccctattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcgtgctgcttcttcatcatgccatgaggctaacatgcgatgttcttggcatgtgctagacaatctctgcccttacccccaaggggcactagctgaacaaaaacaacactaaaatcccctgtaggaagttgattgctagaatacagatatgtgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggtaaattaaatttcccagtggacttcattctcattaaaaaatgacattcagctacatgggtatgacaggagagttgctcctgacgcattccaggtttaagagtggccagccggaccaccacctgcatgcctggctctttctggaacagcagcgagccttcacggagttggtttctgtgccctcggtctctgccagtgaaaagcatatttccttctccctaagtttaacctcaaagaaacactttgcctaaaaaggtgtaaaattctacctaataataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcacttcctctacccaaaggcagccactgttcccggggtgtctttgattctttccagaaaatatcttatatgctcatgtgcatggatccccttttcatgctgtctttacttcattctgtgtattaaaagtgattccgtatcaggacacggattgaccttactcttcataacagagtattgtattccactgtataattatgtcaagaacatacttaactgctataatactatggaaaagtggatcgtttccatatttttatctattacaaaatagtgctggaaaggggaagatcaccattcagaatgctgggggttggggagatgcaagctgcctgtctggtggggggccgccaggtctgccccagctggactggacccaagcactacatccttaggattgttctcactgtttgcagaagcacttcttctgacatggaaaacaaaaacacaatctacatgtcatttttgttgttattatcataatgccccatgcagttaatgtttttgagattgacacatggtgacactcgccctatgaaaatattttatttatcattatataagttattctatgaaattttaaaatctctcatattcatttaattaacccttggaagaagagttactaagcatacacgatcacaaaatttcatcccatcttctctaattgatcttaaacccataaaaatatatatcaatggcagtgttagaaagaaaaagattttactgtaaaaataaattgtagtctcaaaaatacatttgaggcaaataaaccatataatttaaaaagtcatactttcattagttctctacagaaatgaactattgtgggcctaatggctctgatttttgggtatcacttgctcattgtgactagcagtatgcaactcagcactacggattaaaaaaataaagcaagccatctgaatcccaagttgcttcataaaacacctgtcttacaaaatgtaccacacaaaaggtagttcttgctctacagagtttaggaaatgctgagtgtgctgttctgcttgttcaagcaatacatctttgcatagtgaaagttttaagtcctataggaaagaaattggtttaatctggcttacctggtgcctccaactcttggattgcagctctctgctccacctctctgtaccccaactcctgccctgctcctggcagcatctgttggaacctggattgcatgacccgtactctggaaaatgctgctctatatttttgtagtcaagaaattgctttatttctggaaagtttttttctttttttccctcaactacagctgaatagctcaaagtgcttgtgttgaaaacacaggaaacctgagtttgcaaatgttattccttggacagacgtccctgtccttttccagactggaactgtccagtagaactttctgcagtgatgaaaatgggctatatctgcactgttcaatacagtagccacttgccatgtatggccactgagtgcttggaatgtggttactgtgattgaggaactgactttttaattatatttacttttaaatagccatatgtggctaaaggctgccatgtcagacacacagccccagacagaggtcagagcacgaccaaaataaatgcacagaaacaatgctctccacacagaaacaatgcaatcttcacaagaagtctgttttcaggactgttctgagctctctgcagcttataaagctaaagaagtttctccaatcgatttgccataaaactgattttctaacacattattcaaaaagatggatcttacgattttgaaagagtataattattggtcaggtgcggtggctcacgcctataattccagcactttgggaggctgaggagggtggatcgcctgaggtcaggagttcgagaccagcctgaccaacatggtgcaatcccgtctctactaaatttacaaaaattagctgggcgtagtggcacgtgcctgtaatcccagctactcaggaggctgaggcaggagaatcgtttgaaccttgaaggcggaggtgacagtgagccgagatcatgccactgcactccagcctgggtgacagagcgagactccgtctcaaaaagaaaaaaaaaaaacagtataattatttcatatttacctttatttcaacaaaaactggctaaagacaataagaatagctagtggtctgtgttgggttaaaaaatatacttttctatgtgcagctgacccttgaacaacatgtattagaacgtaagtccacttgtatgtagattttcttcctcctctgccacctcggtaacagcaagaccaacccctcctcttcctcctcagcctactcaacatgaagatgatgagggtgaaggcctttatggcgatctacttccatttagtaaacagaaaatacattttctcttccttatgattttcttaataatgttttcttttctctagcttactttatcataagaatatagtatataatacatgtgacatacaaaatacctgctcattagccatttatattattgacaaggcttcccgtcaacagtggatcattgtagttaagtttaagctatctgccgactttcagttgcaggaggggttggcacccctcaactccccgtagctcatcaaagatcagctgtacctcaaaatcacggaacactttctaggaatgtctgccaactgatagatgctttccagatgaatggtatgcagaacttgtttgtacatttgtgaacagtttctttaactaaaataaatactctccaaagctttccatctttgcacttcaagctgtctcacaggcagaaagtctagcgaggcttatttccaatctgcaaatgagctgatcttagagtttaaattagatttttggacacatgtcaaataaacatggactgcatatttttgacatttcataacaccaactttcttttttaaaatgctctttgatgaagaacatcttgtatatcaaagcctaaagtaccaacaagatttgattccagtctctatgtgctggagtgtccaggcggttgaggcaaacttacatggggacagctggagtgaaggctcatgaacccacagttagtcatcctgagaaacacctgttctttctgatgtctccctgaaaacatcatatatttggagactagattttaatctctagtcttaaaaaaactcaatatggtttaaaaaatatctaagcataatttaatgaaattacatatttttacaaaaataaattaaaattggcttgaataagaaaagtaaccattttcttttttccttttattattaaatattgatcatctacatgttttctctttccaaggtccacctattgaaaaaagagcttcacatctatttgttaatttggattttaaactcaataattagttaaatctttgagtaaaagggtaggtatcatcataatttatcttcattgactcctttcctacgttaaaggctgaaaatgaggttcagactctcatttcactaaaacctccaacagtattttaatgctgttgtgataagtcgttcaaaataaccattttcaccaaaaacatatacacgtttctttgcacgaagtaggtcatatcctgtatttgcacaggtctaaaaccacatttgagggaggctttacaacttcatttttataattttcgaaaccctttttaagaaaaccaatgcaagaagatgaacatggttaagaggatttggaaagggtccatgcaagtgaggagcccaaggtgaatgcctcattagttccctgacaaacctgcctccgagcgacacagcatggtgtttgtttaaggacagagtgactgttagatgccttaagaaattctatcgcatttccttaacttatggtcactaatatgatttttgaaattcgattttcatttaaatgtgtatttttctgcagttgccacattttgtttctggatttctaattaaaaacagaaaattccttatccaacttcaaatcattattttaataaattatcacccagacatgtaataccccaagataatatcaaataagataaagatgttttatttatagagaactcagaaggtttgattgccatagctttctgcattcccaggtcagtgagtataatgtattccatattttgttgctgttttccagcactaaacacgtcagcattttgcatcggagtcattaaagtttgtgagatagttctgatgaatagcaataaggccagaaaaaaagaataatgcataacatgaattctttaggaaatcaattaatttttttatgagcagtagtaaaaataggatctagggttagcagagtgaggctagactagtatttggtaccaaaatacattctctgctgcgttctatctatgtaaaaatattctgtgctgagtcaaaactgaaatctcagttctcccaagagtaagacattttacatatcagaatgtactctttacttggccgtgtatgtagcctttgatagagcacaccaattctgtaaattctgcagtactttcaggtttctaatggactttttgtggatccctgaacatagtgttattttggttttctgaattatatactatgtgtgctattaaaacactgtatattgtataagtatataaaggtgcttacgtatttttcaaagagctctttgttggggcaaggtaagcagttctaatactgggataaatgatgattaatattggaaaataaaagtaatagtttgttgatattactcctagattattaagattcactcaaccatttattttattcattcattcattcattcattcattcattcattcatacatttgatgaatgttaaacaccaaatacatgattcaccaagaagaatgaaaaggcttaggacaggaatataaagacaggaaaccactgtaacactgcagcttgaattctgggaggtagtactttcaaataattctttataatggtaataaatttactggatccaccccacatttatcaggcctttcctaggtggactgacatcatcacttaaatggaaatccctgtcttcatttattagttaaggtacattgctcctcggggaacagataagcctgtgacacagtggagcaaagtgtctggaatctgattttccaatggacattcccatatgtttgaacaaaagagtcataaatactaactatagcacctattttacagaagctgaactaaagacacagaagccttcaaatggaaaggatatacaacagaaaccacagctgtgcggaagaccacccaggtacatggtcgtgggtgaaatgactagaagattagaatcctctggagcccagagctcaacacatgggtgtctagctccgaacaattttaaatcccacaaatgacagagaatttggttttcaacttttttatacgcgattttttttgtaacagctaacatttcttgcatacccacatggtaagagttgtactttttctatcttgataattgagggaaaaaaaaattaagcacgggtgaattcacaggcatcttacaataaatctgtgaaccacatcctgataatcactggagttaatgacgtctagggctttttccacatctggaactctgtaattcttctatagctttgctaccaatgacttttccttgaacgatgtattgaatgaggcactcacttctccctgaggcagcttattttgttcttcgttgtccatactgtgagagcaaagagtaaaaagagattcaccttcttctaacttttatgtatttggccatgttctacttctgaaatgacataatctaaccacaatttcttccagacaatggctttccattacactccttaaacccagaaaagatgggcagcttacaaggttatacaaaccacagcaaaacaacatgtatcaggaaaaggggaagagaaagaaggaaacaagtaaagccaggaaaccagtttccaaatccactgtgtttatgacctctatatatgctatagggagcccacagatgtagctttagattttctagcagtcaactgtcagaggaaaaccttatcagctggtttaacatccttaaaggcaactttcctcaggacaagcataaatgtgcctggtactcagatcagacttgaatagtcaccatggttccttgtggaaaagtctgttgggatgtcctgaaccacaggcatcacatttcctgtgtaacgatcacaatataaacaaatggcatggtggcaaagtagtatttaggaaaagcaattatttgaaaggctaaaaatagtaaggtctaggtgcccagtttcctgccgtagatctgactacatcctggattctagactatttggaagagtatatccaatgaatgccatgtaagcaatcttccttgaatgttgggtttttgggtgagctttggataaatattcattaagcttttgattaaatattaaataaatctgcacttaactctgtgccaggaactattctaagtattttacacttattatctcatttagtatgcacaatagttttatacagagttgctcatatataccctattttagagataaggaaaccgagaaagatgaaaaccacaagtagtttgtgaagccagggtttgaacttcacacattcaacgccaccctttttaaatcactgtggaattcctttagcattcaagttaggtgaatatccttctgtgaaagtttgggatttgaagacaaagggcaatgatgaaatcaatttatctctgctgagaagccaaagcaatgggaatggacataagcttgcaaaagtgtatggagactggggcaaaaagacagggagggaaaggaaggcatacagttcagtgcatcctttagaaaatcacttctctgttcttttttcagcttcttcaaattgcaaactgtggtggtttaaaatacgttcataaattctttgacactctttaagatggagcccaactcccttccctttgagagtgagctggatctagtatctcacttctaatgaataaagtgagagtgacaggtgcagctttggggatttggtcctacaaggcactgtagcttctctctgttctctcttttggacaacttgctctggggaaagccagctgccatcatggggacaaacagcctaagacaagggccatgtggtgaggaactgtggccttctgacaacagccagtgaggaactgaggactttttttgccaacagtcatgtgaatgagctaccttggaagtagatcttccagccccagttaagcctccagataactgtgaccctgctaaactgcaaactcaggaggaaccctgagccagaactacccagcaaagccactcacgggtgattcctgactctcagaaactgtgagatgatacatttctatcatgttaaattgttagaatttggagttgctatgcagtcatagataactaatacacaaaccaacaaacacacctccaaaaccaacaaatcgaaacaaattaagataaattaagaatacgctacctacaattgccaaaggacaaagaaaccttgagaacataactatcctcctttaagtaaagttgcctgcagactcttttaatccaaagacattacagcattttgattcacttctaaaataatttgtcatgatttgcagcttaagtatgtatgttatttacttataatttacttgtataaaaaagggaagataaagatattcaagatttcacattacataaacccttcaacattcttaaagcaaggtcaacaaccaaatgcaaaagatgggccagcaaaagtctctacctcctaagaaaagttaaaatcttaaaatccagctttagaggatggaaccacagtaggcaattagcaggcagaagcacataatttagccagtagttaaaaacaattcattaaaagctcattttaaaagacaacatttgctagcattctgatcccagaggttggcaacctgctgaggccacacacaatcattgcagataattcagcacatgataatgactaaggctggagagtgtgtcctgatttccatcgtctccagggagagtaaacacttgagttttcattctaatgcaatcacgattatgaatccagaggtatttctttccacttaggcaccatggtatctcattatttttcaacttccacttcctctactccattgctcaacccaggattttatgagccccactgcatgacatacaggaagctttactaaggggaaccaatgctaatttatttctagatgacttacagtgctcagccccaaatcaagactggctaatacaactctgctatctgtgctccttcttgcacaaaactcctcatgaagttgcaattttaaaagaaatgtttctcatcaaaattcaatagacttttatatgcacatacactttctcacttttccaggctgcatgaaatttaatatcaggattattatccatttgtcattttaacctataatttagtaagcctttttgtgtttgagttatgcttcttccccccttgagccatcagcttgcagccatagattcatttgaaaagccggccaggtcacatggtttgacctcttagaacaaacattttccacatttcttattctgcttccataagagacaccattagttttgttcatctctacttaaaatgatttttatgacataataacatttcaagttttccacattaaccttcattttatttcttgaaatactcaggcaaacaatgtcactaagacgtcactgatggagaattctttctccttcactcctgtctacttaaaggcaactctgaagaaagaataaatttttgctctgcatcagctgagtgctgggagaaaagtttaaaagtctggcctagtggctcacagcatcttaaagtaaatacttccataagcaaccaaagcagaaaatcttcatataactgttttcaccaaaataaatacataaattttcaaatctggagtcctataaaggaatttaaaatctattttcttatatgtaagttcaaagatgtctaagtccaaagggaaaatgaaaataaaataaaaatataatcccagcccatgtgcaaaagcaaacaaggacaggaacacaccgctccaggggtgtgggcagtactcaccccacagcccaggccattgcccccttcgcaggtgactttcctctggtcaggctccggcagcagccccgctccacagccagggcgggggcataacacgccccccatctgcaggacacactcctctgcaccatactgctggtaccggttgtactgcaaaacccaaaaagcagattgagctttcaaactgactgcaaatttcagccaaagggttaggagctacagtgcatgggatttcttgcttaaccagtttcagtaaaataatgcatgtgtgtgtgtgtgtgtgtgtgtagggggagggagagggccacggggttgataggggaggacgaatatggttcaatgcagtaaaagtctaccaaattcaactggcaagacatataagtgtgtttactttttgcttttttgtcttcagaaaatagattttccaaagttttgtattttataagatcgcttctaccaactgtattttaacaatcttatttcatatacattttgaggaacatatttatgtattaaatgatgaacacttttaatacatcgctatcaatcttataaagcaatatattgtcatgcctctatttaaaattcaacaaggttttatatttattttgaaaatcggcccagcattccacctcataatattggcagcccacacaatatcaatgagctagaagaagactaatgttaaacaatcacattttccctttatcattattcttattcttaaagcatgatttcttgtgtccctgatgtcatttcttcctggtaccgttttgctcaatttcctttaatggtttccccagcctgcaaataaattccaaactccatcagaccattttcaaggtcttctttgtggcagccctacacttttgatcttacattatttgtaatataaactcagatcaagtcaaataggtttgctcaattattaattaaataatgcaacatttattgagagcctactacattccagactctatcgaggcgctggggatacagcagtgaatgaacaaacttctccgccttcatccacagcactgtaacagtcaataccgagaggttagaatgtctaggatttccaatggtgctaagtgaggaagaaaataatcaacagggaagagggagagtccaaagaaggtggagatttcaattttaaagaggtgattacagaatgccttacaaagcaggtgtctttaagcaaatgtctgaaggagattagaaatgcaagtcacatggatccctgggggaataagcattccagacaagcagagaatactataaggggccagagccccagtgtgctgatgtggttggctgttcagggtacaacaaggggggcagtggggcggaggcagagagaacaaggagggaaaaaaacagaaggtgaagttggagagtttgtgaggatctagaatatgtagttccctgacagctgctttcagaaccctgggtgttattctggaagataccagaaccactgcagaactctgaggctgaggcatgacataatttgactaatattttaaagacatccacctggctgctatgttcggaataccctctggagggccagggtgtaggcaggaagcagagaagcttatgtcaacatctatgacgtaagctaggagcttatgtcaacatctatgcaaaagatggcactggcttgaaccgggaaggtagtgctggaggtaggatgagtgtttgaattctgggtataaattaaagggagaagttgcagaattttcagtcaggttggatgcctggtgtgagaggaaaagaggagtcaactgtgagtggagtgtagttccccgtttcctgagaagacaggaggcgggtaggggtggggacaactgtggtagaagaaagggtatgtgtgtgtgtgcacgtgtgtgtgtgtgtgtgtgtgtgtagggagttgaggcatgaaataattatttctattgtgctcgtgttcagtttgataagctattacacagcgatgtcaaaatgtccagtatctaattgaataaataagtgtagtttaggagaaaggcatgggtcctgggtacaaattttgaagtcattagcctgagcctctaatccattttctcattcttctgtccccaggaaagaaagaaaaagatgacctggcctccttgtaaacgtgtgaatggcatacacatacagcacctttaccagaaaagaggtctaagagttcggatggcaaacaaactagaatctctgaatttatggggtaaggttctctggacagtgtcataagctgtgcaattaccagaggatacaatgaagatatttcatcaggtaatgaatgatgagacagtttatgtaactgagagattgcctgtgagtgattactgcatagatttcttagaggcttcatacataacccttgcccacagcacagccccaaatgccaaggaaggacctggggaggcgcgctggcgacctgaacgtctccaggtcctgcctgagtctcaggattacctgcatccttgaaattattcgtaaagctcgacactaggttagatctatgacactctgaccatgttatgaggtcagatgtgattatccaacctctgcagggaaggtgagaaaacaccagcaaaggagactaaggagcagcagcctatgaggcaggtgaaaactgaggaggactcaggtgtcccgaaagccaagggaacacatctcaaggaggctgccatgatgagctgtggttggagctgggtgtgtggctgccattgcggtcttgaaaagtcatttcagtggagtcatggagccaaaagcctttggagtggagtccagaaagactcggaggagagaaattcaaagaagtgagaatagacacttttttaaaggagtttgccagtaaaagggagcagagatcggggaggccattggataggactctggggttgtaaaggattttcgaaaatggagaaataacgatatgatactatgctgaaggcaggactgagacgagaagcgcagatggacagtttaagccagagaaagagctctgtccttgagtaggttggaggggaggatctaaaggatgtgtggagggttggccttcagagagcaggcagccatccttaggaagaggaggcccggctgagtgcttaggcccaggtgcagacaggcagaggggtactgggatttgaggaagaagaaacgtatgagtgatgaaggaaggggagggcggaggaagtcggtatcactgctgggcggcacccaggccctcctgaggtcagagatgatgaatttaaaggaaaactcgtgagcagagtcttctgtttctctgcaccaacactgagctgcaaaggcaaagtagaaagaatggtggatttaagtttggttgcagttttgccggaattgtaaaaggaagcgggacatctctcgatcacctctgcctatgactgtgaatgatctcacggtgatcctccaagcccctctccctcagctctgttcacctccgcctatgactgtgaatgatctcacggtgatcctccaagcccctctccctcagctctgttcacctccacctatgactgtgaatgatctcacggtgatcctccaagcctctctccctcagctctgttcacctccgcctatgactgtgaatgatctcacggtgatcctccaagcccctctccctcagctctgcatcaccgaactgctcaacctacttttttgtcttgacctgtccaaatccttccacattgaaaaaaaacaaaaacaaaaaacaaaaaacaaaaaactttttattgtaaatatcacatagaataagcttaatacattataaagtgaccaactttttaaacactacccaggccaagacacagaactttaccaggtccgcctgaagccctccatgtatctattctcatcacaacaccttcaccccttcctaaaagacaccatggttttgttgttgtttttgttttttgttttttttttttagacggagtctcgttgttacgcggctggagtacagtggcgcaatctcggctcactgcaaccttcatctcttgggttcaagcgattctcctgcctcagcctcccgagtagctgggactacaggtgtgtaccaccacacccagctagcttttgtatttttagtagagacggggtttcaccatgttggccaggatgatctcgatctcctgacctcgtgatctgcctgcctcagcctcccaaagttgtaatcactctcttgtttttctttatcactcaaggttcatttctaaacactacagttcattttgtctgttttgaagatgtgttgtttagtccatcaccctccattgtctttttttccttgcaatttatctgttgaagaaagcaggacatgtgacctacagagtttcccagtcttcattttgctgattgtatccaatgttgcagtttataatgcacctggataatttttttcctataaattgataattggtctataggcttcatttaattcagcttctttccttccttctttcctctctccctaccccctctcttttcctccttttttccttcctccttcattctcatcccttcctccttttttggtccctccctctatctctctgtcctcctttctcctcttccttctttctgtctctctgtaatactacttcatagatggtgttttgtacttctatcaggaagatcataatgtctttctctcttcttgaaagcttagcagtcattaatattcagtaactagattaatttattgggattgaaaaatgatattttaattcaaacattccttcatttattagttagaatacttctattttttggttatccagtggtattgtatgaataggaaaggcaggataaaatatttgaatcttttttttcaatgaacatttataaactcataaacttaaacatattatgtgttaagtgtgttttaactcaatgcagtgatttccttcttgatgcacaactatctcatctctggccaatggcaatcctatcaagatgagtttccataacatgatcctgacaccattcaatagcttcctcgctatctgctatggaaaattactcaggttcatcttacacgtttcctgctccaggccaggaattgcctacttttaaaagaagcactgcttcttaaaaatttcaagaccataaattgggtgctaggcatgttcagtgctcctaagttagtcattgtttctaagtcctctcagttctcactttgaaggacaggtatctcagaactacaaggtttttacttaacattttctgttttacctctgttgctcctttcttccacactggttctcaagaacacagaagatgacataattacaatattccataattgctcatttgctttttctcacattacacaatttcagaataacaataccatcactgtgcctatgatttctgaaaacttcaaatatgttttcatatgctctactcattctcccacaaaatttttaaaataattatactgtatccacactgttaacacatgcggccatttcgaactatgctgtctttctcttaaccttcatgttatcttacttctatacacacacacacacacacacacacacacgcatgcaggcacaaccatcagtacttatgttgatggttgatgttttcccagtaattttgattgcttgaatcttgttctctagtaaattcctcaggaagagttcctgggaaatacagtcactgagttcttccatagtaacagtttatttagggcttttattcttgataatgagtttggctgcataaaaaatctttatattatacataaaaagaatatatggaattatagtttcttacagtatacatataaggaatatacaatcctgatatacatacagggattgtgtgtgtgtgtgtgtgtgtgtatatatatatatatatatacatacacacttatatttatacatacttcccccttgagtatctgaaatctcttacttcatgttcttctggtataaaatattatggataagcctgaaaataatgtttttttcctttgtaaattaattgccctcttttgcctagatgcccaaggaattttttccatttctttagaatccaggaattttgttagagtatatcttggtgctggtcatttctggatcaattttcacaagcatactgtgtcaggaaagttgtactgaatttagtttttagggttcactttgttcagttgctttgatgtttttcttatgtcatttctagtatacatatattggatcttctttacctcacttctaattccaacagcttatctcaaatccctttttaattttcttatttgtgttttttagaatttccttcacttttcattttctatttcttttaagacaatatctattatatgtatttgtgtaatttcctaataatttcctaataacttggttcaccttgaaaaggttattttggctttcctttgatttgaggcattcttccattgtccataaggatgctattttgttctacattcgctgcatcattttaatagccctgtacgggactgaaccttgcttcttttctgttagagttttaccttgttcctttgctgttgctcagttttacatgaaattagttctcctgaaattttacaaagaggtaggattcagaaaaactgtagacttttctgttctggtgttttaggcagtgttcaaaaatatgggggcttcctttctgcaatctcacaactctgttaccccatttttaaccggactatctccttcctttttttctcttctattttgagcaaatttctgctcagtgtggggctttgtcctgaggagggcctttgcctgggtaaatctggtgagtgcatgagacctaaagtgctccaagccctttaaaccttattacagacttttgcactcattcctctatccttttgtgcatccacatggcctgagtttggcatagtatcttgtcaatagtttgtggacagtaaataattataaattaataaaatctaactccattaagtgacaattaattaaataattctaataagataatcaatagcaatggaaattaataacagtaactcaggattattttacctacaaaaataattttttaaaataagttgctcttaagtaattgactattttctcatttgacaacacatcacctagtctatttaatttagttaggtaattttattactatgacaatagcttttatctcggaagaagttaatgtatggacaacgtccaataacaatttagaaattcttgttgactgcattcatagtggtctcaaatattgatggaattttaaaaattatgtccccctttccattcattagctagggaatttattaaaaattattgttatttattttgtttatgataaactcaagagcatttgagcatacaattcctttttcaaaggaagacaaatattttaacatatgcgcctgggaatttctgatgattaaaaagtacacacaatacctgaaatatgcctattgaaagtattacttttcaaaattaacattgtgatatttataagaaaaacactgacctggaacaaagaatgtgctagtatttgtagaaagcttaatatactaaggaaataatttagtcatgtaattacatatcattagcaaagatccttactaagttaccttcgagatataatccacagttttcatagatccttttaaccatttactggcacgaagttgaaagcgcattaatggagatttgtgacaaactagcactaatacagaatactgtatttatctcagtataaaatatgtgtgataatggtaaagtaactaataaatctaccccagttggtggaagggaacaaacacttcccttgatattcttgtattggttccaagggcttttttacttatcaatattgaatagcattttataaacagactaacttggaggaatgtgattaatttataatgtgaactgggtttatatagagtccaccctcaactgagctcaaaagtggaaaaatcactcatgcatgttttgtctatggaatgcacagtgagcatctgtgtgtgtgtagatatgctaatatttacatgtcaaactatactgacagttttaagctattaaaaatagtttgcaaatttctagatatgctttcataaagtgaataatccacagacaactaaaataattttgaatttattgtacaatatttgcaaaaatatttgaaaataaatgtaaatattcacaaagaatactactctgaacctaaggaaaacaataactgtttttctcctgtattttatcagattatagcaaaaaatacatttcattagtatgcgttatgcaggtagaatcctgactcactgctatactttctattttatttctttggggagtaaattattcagtctttatgtgaatgctcatggattctcttaagaacaaaaagtattcattttaaagcataaaattcatagaagtttcaataaactcgtattttaagaatttaaataatgggtcatgggagagtataatgaaatagatattgtattctgttagtctgcaggttaggagacctgtatttgggtagaaaagtgttctataatgaaggaacggttgcacgttcaagccccagaagggccagtgaacttcccctttcttgctggctgttgactgcatgttaagtacattaaaggaacatgggtagtcacctgagaagtgtggctatggggaaaccaagcgtaaacatcccccaccactgaaacaccatccaaaaggcctctcctctgtaggagagaacaggctgcttcactctgatgcttaatttgcatgctttcatagaaaaagaagaaaagaatctaattttaaaaactacaagaaatgtgaagtacagggatccgaggtaaaactcaagtctgagaaaaatggcacatgttctgtcaaaatgagtcaatgcttgccagccatccaggagctatgtggccccctttcaggtcctccaagctaaggaggttgattttgtgctgtcatagtgtttcccagagtatccttttgggggcactcaggtacagctcttgggtctcctttgcttccccacaccactccataaattatagcttttgttacatctcagccaaaagcacttcggggactccctccctgggcttctccctcaatccctcctagagcagaggggtcgtgatcaggcttctgttcactgagctactgcagtgaaccaaaccacggcaccgacactttgctgctcggttaattctctgtccactctgtgaagtgatggatgtggcctcggagccacaaagaagtgccatcttttgctgacatccacacaggcagagaacccacagtgctgcattagaactaaggctgaaactttcaagaccacgctttccacaatacccagctgcctctttctcttattcccttctattaaaaaaaattcagtcaggtatagtgactcatgtctgtaatccaagcactttgggaggctgacgtgggaggatcgtttgagaccaggagtttgaggccagcctaggcaacacagcaagaccccatttcgacaaaaaattaaaaaaaaattacctgggcatggtggcatgtacctgtagtcccagctactcaggaggctgaggtgagaggatcatttgagcctagaagttcaaggcttcagtgagctgtgatcacaccactgcactctagcttgggcaacagaatgagactttctcaaaaaaaaaaaaaagaaaattcagctcactattcctctgccatcttttagaaactaatgaaaaatagtttattatagaacttcctctttggattaaaaaaactataataacgtcagagaggaacatcagcttatgatttagccatttctccttgctatgcagataatgtcccattttctatacgcattagaaatttttttcaaaaaagaagcactccttagattgtcagtaatcttcatcttcctttttttttcatttgcaggtagttagcctgagagcatctgtgacagcctaagtggtggcccccatgaccctgctgtttttcttctctattctgttgctaataatgttttcttcatccctgaacatctgtcagctactgatgaagtgaattggctagagaaagggctggaccttgttaattgcatagaaaaaactatcaagatggctgaaatcaaatgcaaagaggcaacatcaaacaagacctaaaaaaaaaaaaaaaaaccagtaaacaaaaaaaacaagcaacagatcatatccggaagcacagtttaagaagtttttggtttttttttttccagatatttcaggtgacccaatgccaaaaagcatctcatcttctagtagttgtggaatcttctggaaaagagatccaaatcaactggcttccttgtcccctctccatgtgtgacacggagcagcacccacttccagtgtagctcccctttcaggggagggctacaaaggctgttttcctcacaagagttcctacagctgatgtgacttcagagactcctgtagactatggaaacagggtggtgaagcgtctcctgatggagcgcactgcagaaagcagggttgtctgtggctgtaaattatttcactctttgctctcatcccagagaaacagtgttagggtagcacctaaatctgcaaatccaagagccttgcccctcagataaatgagcgttgcctctgccttccttgaaaggagctggggcacaggtcactgccaccatcctccttcctggctccctagtctttttctttccctgaattcagtattttcacctctcttctttctgcttattctctagaagctctttgtccagtcctgaagcaactgcgatggtttctaggtgattctgagggaagggtgacatgtcattgtctggaagttttgtgtaaggctacgggtggggcagtgaaatgggttagctccactgagcatttaatgatctaattagaacttggatgaaccaaaatattttttaaaatcatgtggattgtattagatggcttcatatttataactatctgaaatggacaagcctctaacactgaggaagccttttggggtgaaagccgagaagctgccttaatgccaaggcacacctgagcacaggtaacaacagccaggtgctctggatgtccacctacgtccctccaaagatcatcacaatgcatccctcatgccccacatcattgcttcagaggctcaagctgcctgtcattcttatcacccaaactgtcagtcccatatgggtccatacgtttcctaatatcagccaatttccatgcttccctctctcctaagccttttttctgtgtcccctgaaattcctgttcatgataaactaactgccctgtataatcagccttttgaaaggtttccctgtccacactgacttaactgaaactgatccatctcccttgcaaccttttcaagtgaaggctgcttttcatttcatattcacatctttcaaggccagaggtgaagatggttgtcccttggctccttaacgacgcccccaaatgcttgggttcctctcccttgcaaaacccaccactcctttgagacccatgcttcaccctcacctcctcactgctgccccctgatctcctggatgcagcccctcattcttgaagactgtagcttcaggctgttctcaccttttctccgattcttgtcatcattctggggacttgaactcctgtatgaataagccaccatcaatctattctttctgttttaccttctcatcctgctgacctttttctcatccttctattcgcacggtccatccccaggctctgtcatcctgagaaactgtaccacctctgaaatcccaattccaaatatgtctctttctgatgatcacctcttatctttccaaatctcttgctaaagtatgaacattgcttaaattcttcaacttcatcaagacgtctaattaattggccccatatttcctctccagccatgggcctctccaggcccaccttccttcctggtctgacagcttctgtcatctaccaccagaagcattgcctggaaaacacagatttccgtggtcttctttatctgatggcaaaattccacgcctggaaaacatcacctccaccttccctgggcgtgtagccctgcagctggacacaatggcacgatgactttctcttaaataatggaccacaaacttcaaatgggcatttacaacttcctcaagattgtattgtgtttctccagtgacatgttctctcttctttcttcccctcaacccgccgaaaaaaggggtgaaataaaaaagatgaaatgaggatagttacaaaagcataggagatagaagttttcacatagcaagggtaagaaatatttttataaatgttggtaatagttatgataattagtagaattaggataacagtgaagtagttatagaagaaaatgaatttattacttttatctggagttgcaccaattttttggttcctaagaccaatgtaggtaggacctgcctctctccagccatccatactttatatttcactgaggagagaggaatcatggctgatgtcctgatgtgctcaacagatgtttcctaagcacactctaagtgtcaagtactcttctatgtggaagacgcagcagtgaaaaatgacatcttccttcgtggagccatcatactgcatctctcctcttcacatccctgcaactatgaacacacctgcacctgcactcaccctctccagcccctctcacaacacaaaaagtggccttcctcctgttaggggccgattcctccctctctgctggatctgagcccttcttgccttccaaagtacttcccttcttcagttcttggatctctctctcaaattaccggtaattcatctctgtggaatccttcctgtgagtgtaaaacaagttctggcccttcgatctttaaagaactgtcttgtggttgctgcatttctctttctcttcatagcaaaccctctagaaggaattatcctccccttctgttcactcttcatcccataaaactctggctcctgtctttacgcatcccccaaaactgctcattatggtcattcgtgacttttgccacagtgtcacaggcgaaggacgctccctgacctcatcttctgcaaactctcagtagcattcaacacaaatcaccattcctcctctggaaggcccgccttctcagcttccccaacaccataaatcagcattcctcctctggaagccccaccttctcagcttcccaaacaccataaatcagcattcctcctctggaagccccgccttcttggcttccccaacaccataaatcagcatttctcctctggaaggcctgccttctcggcttcctcaacaccataaatcgccattctcctctggaggacccgccttcttggcttcctcaacaccacaaattgccattcctcctccggaaggcccgcctacttgccttctcagcttcctcaacaccatatggccctggattgtcttctactttccttgaggttccttcttggtctcctttgttggttgctgctctttacccaatttccaaacactggtgttccttacggttcatccaatcacggtctctcctttcttggcttcttctgagaatccccatgggtttaaaatttcctctacatgctggtaattccaaagttatctctccatctcggacctcaggtctcactgtcctccaagctctcactcacacatccaagtcccgacttatctccttctccatgcttcaggcatagcaaatgtgttcagaattgaagctcagatcccatgcctctgatctcacctgccccattttgctcatctcagtcaaatagaactttcaaactccttcctttccctgacccacagccagtcagtcaccaagtccttgaattctgcctctcaagattcacttctttttgtctccgctgccaactgtcttaatccagagcctctccatattgcaacaagattgacatactcaaaatgtaatttggataatgctaaccccttgcttaaaccttcaaggatttcccactaaactcagaacaaaacccatatgcttaaccctggtgtccttggtccaggtggccttcatcttttggcactgtccttcctgctcagtattttccagccaccttggtttaatttagtgtcttgaataaagcaagctcttcacctccttgggggcactggatgtgtgctttcctctgcttgggatgctcttctgcccactcccataatgctagctccttcaatagctggtgtcccctcaacgcttagtctcagggctcctcaactacccctcatctaaagtaggtgacatccctatttgttttcatcctagcatcaattatgatcagtaactgtgacttcctcatttactattttatccaacactagcacaataatagtacaagaaagtattcaatacatttttgttgaatggataaaggttatttccataaaatttcagtgattaaacctaaggtggaggaagctggtataaatggaggtacttctgaaatgcaattggttcaaaggccctacaaacctattgactccagacatcatacctgatttctgaagggctcacctggaactgcagagtgactttagtttcctacaatgtgataatgtctttgccaaagaatttggactagggggaaggagtgttgaaaggtgctatatgaatatgaattgtgaacacaaatcagagaaggggctaagaagctaatataaatgtattattttaaggagtttatttttattttgggaaggcagtgatacatagtgtttaatttttaatccaaatctaaaaaatcaagatacctactaaagatcaacgaaaacagaaaggaaccacatacaaagaaattagaggtctgctgtgggtctctgccatacagtaatgaattagtaattaaccagcatttttgtaggttttatcaactcactttctaagtgagtattacgcttactttactgtctattttgttgccactatgtaaagctggaatataaacagcatttaaaatcagaggaattttagtatagcacaatatttgcaacttacttggcaacctatttatttacaaatattctaagagatgattgagcttcactctcccttgtctacaaaaagctaagttagagaaacaaaaatgatttgtccaaggatgcttgtaacagacattaatataaacattttattttatcaagtgataacagttgcctcaagcatccagtgagatcccaagagtttcaccagctcctggagcagttgcccccaccgctggcaggaatgctgggacaagagctctctgcttcctctcgggagcctcattgccaccatctgcctagaggccagtaggtcttgtcatgaataatcaggatataaacgtccctgactgatatgccctgttcacgacagtcaccaaagaatgcctgactcctgttccatctctccaggctgagccccaagctccacatccactctgtgtatcctttttcctaccacatattccagctgccccaaaccctgagacccttcccccatgcttggggaactcatgggcaatcagcagtaactgccctatgactgcaatctgctttctcaatgtttttcttacattcttccctaactgaaacaggcgtgtccctgaggacactacttcgcctgcagcaccctcaaatgtttttgtgtctgcaatcccagtaccacaaagcattgctctacagtgttgtaagtaaaacattttccctttctccttctaaagccctccaactttccatttcaacccatcagcctacaccatgcactatttccccttctgctgtcagctactgacatccatttctctctctctctctcatttctcaaatcttcagtttgcaattctggaagatctcagcgtgcacaggggtggtactcccaactctccgacttcccaattccatgacctcaacttctctcgtcaccttgtcctccatctgaaatcagacacacagcctccctaggcctcctctgacctcgtcggtgctgaccatgcagctcctccacaagctcgatgtgaagtctttcattctttggccaatgcctgtttgtccagttcaacccttctagtactcaaatcccgaaaattctttgagccactggcatctgtaaccaactttccctgtcctctctctcatctgggttctctgcttgcccagctgaaatttcatggtcggtcataatcactcccttagattcaccctcagcttacactgttgttgtaacactgtaagatgagatccaccctcagcttcttagcctccctcttgtttttgttacattttgaccgcaaaacttcaatgccagtgccttttctgcatctgtgcctacacagatgagtgtgtcagaaaaacacccagtggattgacctcactccaaattcaaccatttcccaagtttattccctcctcaccctcctaaatgacaatttcattatcctctcctgacatggtttggctgtgtccccacccaaattctcatcttgaattgtaatccccataatgcccacacgtcaagggcgggaccaagggtggaagtgattggatcatggggatgattccccccatggtgttctcgtgatggtgaatgagtcctcacgagatctgatggttgtataattggctggcatttcccctgcttgcacttttctctcctgctgccttttgaagaaggtaccttgcttccccttcgccttccgtcatgattgtaagtttcctgaggcctccccagtcatgtggaactgtgagtcaattaaacctctttcctttataagttacccagtctcaggcatttacttatagcaatgtgagaccagactaatacatctcctttccctctaaaactcttccccgatctgtactctcagctgatgacctagcttcctgttacaccaagaaaagagaaacaaccagcagagaccctacgcaaggtttaccatcaaatccaatgctcatacgtctgtgcctgcatattctgtctcccccactgttaccaggcggaactggccactctcttgtccaagcccatgcctacatccaaggacactgctcctgaattctcccttcccccttctgcatcatcagtctcccaactcctctactgaatcattaccatcagtacatagacatgctgcaatttttcccattaagaaggtcattttcttatctccatccctcagctacctcatttctttgctttcctcttcagctaagttcccagttgccaaaattaaaatgtatgtatttgcagtctcccactctttggttcacctctcacatgaatccattcgaggcaggctttcccctcactgcccatggtcaaggttaccaaggacctccacattgtggagtccagtgctcatttctcatccttgtccttcttgctgagcataggacacagatcatgattcctcctcctaaagatgccttcttcctttggctcccaggtcatgatacctgcctggattttttcccaccttattatcattattatttttctgagacagagtctcactctgtcacccaggctggagtgcattggcacgatattggctcactgcaacctccgcctcccaggctcaagcaattctcctgcctcagcctcctgagtagctgagattacaggcgcccgccaccacacccagctaacttctgtatttttagtagagacagggtttcgccatgttggtcaggctggtctcagactcctgacctcaggtgatccattcgccttagcctcccaaagatgtgggattacaggtgtgagctgccacgcctggcctcctcccactttattattgcaaccctatctcatgcaatgtggctccttcctctttgttttgctctgtcctcctcccctcccctccaccagtcacacttgtttctggactattatgaatgttaaagccaggcacatgatcacattggagcctctgttgttgcttcatccactctgtggaaatctcctttcccagatgtcaccatgaggcttctctggatacctttcagtctttattcacctgtcacctgctcagtgaaactttccctgaccaccttatataaaatttcacctcttcctccagtattcactgtccttgttttttttttttttttgtgtgtgtgtgtgtgtgtgtgagagagggtcactctgtaacaaagactagactgcagtggcacaatcttggctcactgcaacctccacctcctgggttcaaatgcttcccatgcctcagcctccagagcagctgggattacaggcgtgcaccaccatgcctggctaatattttgtatttttagtagagatgtggtttcactatttcactatgttggccaggctggtctcgaacttctggcctcaaatgatctgcctgccttggcctcccaaagtgttatcattacaggtgtgagccaccacacctgagtgctgtcctttttcatttcctttttctccatagcaatgatagccatctaacataatatacactaaatgtgtttatgtgtatataatatggttttctctaagtagaatatggagatttttcactcctctatccctgtaacctaggatggtatatagcacatagtaggtactcagtaagtatcagctgaaagaaagaaggaagtgtgtgtatgtctgcatgtgtgtgtgtgtgtttgcgcgtgtgtttgcgttttaggaaatagagatcaatattgctctgatgcactatattaccaaaactaatcgtagtgatattaattttgattatggctcaattaaatttctaggagaatgcaaagtgacctgacctttacaaagcagatctgaggagatgattactgttggcttctttccttactaattacccatggactctaaaacaaaaatggaaacactgcaaatattggtacaagtttgaagagaagactccattatctgagcagaattgtcagggtaacaaccagtgattcttgctttaagaagtctttaggctttcactgggaaatggctgtgagatccaggtgtcttcacaaggagttatgtttgggagagtcagttgtcaacttttacctgcaatacgggataactgatttcacttgtatttgaatatacatttatgcctgctattctggaaactcacaatatagaaaaatgaaggggatgtactgtaattctctaactccaggatgtggcagtgattccagtttcttatcctctccttactaatccttttgtttttattctcatattggaaatgggcagttttactttgccacatacatacaccaaacaaaaacacacaaaccaaaaactcattgatgaaagtgagctgccacatctccatttgcatatttcctggtcaaagttggcagagacaatctttaggagtaaaaataaataacactgggctgggcgtgatggctcacgcctgtaatcccagcactttgggaggcagaggcaggcggatcatgacgtcaggaaatcgaaaccatcctggctaacacggtgaaactccgtctctaccaaaaatataaaaaattagctgggtgtggtggcgggcgcctgtagtcccagctgctcaggaggctgagacaggagaatggcgtgaacctgggaggcggagcttgcagtgagctgagatcatgccactgcactccagcctgggcgacagagcaagactccttctcaaaaaataaataaaataaaataaataacactggaagttaggtcaatcagccttttgccaactctttagtgtattttaaggataacttgacacctagatttaacatactaatacagagtttgtagttccatatagggatcaagaaacgtatttttaagcattccatactatatatgtgtgtacatatatataatatttagcaccctgaattatttacttagcatatctatttaaattatgacacgcctcactgagcacaacacagcatttaaataatccacttcaaatggtcaccctttgtatagacgtcacatgttcatacccgtgtacaaaaggctgccatgaaatacagataacaaacacccaatacaaaaacctggtaaaaaaaaaaaaaaaatgctcacacattcacccacagacagcaacttaggaatgtctatgaccatcgatccctcaggcataattcatctctgcatttatttgtttgctcatctgccactatgcagtgcttgcttcctgcttgagtcttgagatgaaatgcactgcactggcagatagcagatgtagcaattaataacctgtcaggtctgatggatagaagaggaaaaaagtgtcctcacacatatctccagcatggttttcttccccatttcagggcacccagggtcaggagacatactcggcctccctggggagcccaaactgtctcattagcgtctatctttcatgacagtctgatgcagcctttgagatgctcactcacctgctcttctcccagaatcctgaagtgatggagctctttaatcaaggagttgggacagccagctgttggaaagaagaattaatcacaaaaacgtcactttcactctgtgtggttatatgttcttacacagagttatgactatcaactgccagtgttgccttttgggaggacacagacgtgtacctgaaaaacacacatctaaccaaccacaaaaaaagccaaaccctcaaaagagctatggccgctgcctggcctccaaccgcacctctttagaaaacagttgcatgtgaccctggccaggctttctctcccctctgattatgatctggccttaggatgtcatgccactctggttcttagaaacatgttcagcatgtcactggttcctcatatatagccaggattccgcagggccagagtaggggagttggtgaccacaggctctgacttattcatcatgtcctgtttgctcaccatcaaggccaggggcctgctcattgagaggtaagagcaaaggtcgggtagctacacatccattctttggggggctcagctggcggttagtaccttgcctggttttgtcaagaggctttgtgaagacctattagatcttgcgtttgagtttggaaagggcatcttacggaaggaccaagagagaaggcccagcagttctggtgcctatcactttctcgttccacccaatcaatccaagctccttcagactttcaccttttccttcttcagttgtaaaacaaagtaagtaaataggtaaaaaaaaaaaaaaaaaaaaaaatatatatatatatatatatatgcacacatacacacacaattaaaatacgtatgtataaaatattatataattatatttaatgtatagatatgagttatatatatttttatataactcacatatataaattatatatgtaaatatataattttatagaattatataattaatataaatattggcctaaatatatatatttatatataataatataacatatataataaatattctatgtaaaataaaatacagttgaccctggaacaacatgggcttgaactttgtgggtccacttatacacagattttttcttctgcctctgctacccctgagacagcaggaccaacccttccccctcctcctcctcctcagccactagctgtgaagagaatgaagatgaaaacctttatgatgatctgctttcacttaatggatagttaatacattttctcttcctgatgattttcttaataacattttcctttctctatcttactttaagaatatagtatataatacatatgacctataaaatatgtgttcatagactattgatgttataggaagggcctctagtcaacagtaggttattagtagttaagttttgggtgagtcaaaagttccacatagttttttgacttcagggatgttggtgttcctaagcctcacattgttcgaggcccaaatgtatagatatgtaaaatttaggccagtatatgcttaatatcatttaaaatgtgttgcatccctgtcttttcaatagaactattcctcgatattaggttgtagtcatttatactattatttttttgagtcagggtctaactccaggctggggtgcagtgtgtaatcatggctcattgcagccttgacctcctggctgaaggtaccctcttgcttcagcttcctgagtagctgggactacaggtgtgtgcaccaccaagcctggctaagttttttattttttcctaattttttgtagagatggggtctcactatgctgtccaggctggtctcaagctcctgggctcaagtgacgctcccgcttcagcctcacaaagtgctgggattataggcgtgagccactgtaactggcttatttatattattctctctggaaacaaaattgatataaaaacctgtttctttgagataagacctatggattatataatctgttgaacttcctagtaaggaaactggattgtatgcaggacatatcaactaaattatggagccatttctcatattcctcagcattgtgatgtgagagtggtcagaagccctgagagtgtttgtctgggggagggcaggctgaggaatgagaaaacctgtattcacacaggtgaaggtgctcattgcgatacagattagatctgtgcattgtttcagagagtaggatttaaaccaacagaagaaaatggaataaactgccttataagacagtaactgcaggtttttcaacacatgctaaatgaatacttatgtaggatattttagagaggaattttactgggtatgatgatgaatttatgtgtctacttgattgggctaaggggtgcccagatagctgataacatgttatttctgggtgggtgtgtgagagtgtttctgggagagactggcatctgagtctgtggaccaagaagatccactctcagcaatgtgggcaggcatcgtcccatccactgagggcactgagggcctgcacagaacaagaaggcagagaacggtgaatgctctttctcttctagagccttaaagatcagatttcctggttctcaggccttctgactgcaagacatacacgactcccaaacctgctgcccctagttgtcaggccttcagacacagactgaattagaccaaaggctttcctggttttccagcttgcagatggcagattgcaggactgcttggccgccataattgtgtgagcccttcccccagtaaacgtcctcttgtctctttctctttatagatcctatagacagaaaggtcctgtttcttgggagaagcctgactaatacactgagttatttccaattccaaaattctatggtcatgtaaaatgctggaacatagctttagcctatattatataacatttcatatgttgagaaagtgcttcacaaatgtttactgagtagtacaaaagattacaaaaatgtgaacaaaatttaaacacacgtgtaaacaggtgatgccaccaagaaaataaataaaaatcctggccgggcatggtggctcacacctgtaatcccaggactttgggaggctgaggcaggaggatcacaaggtcaggagtttgagaccagcctggccaacatgatgaaacgctgtttctactaaaaatacaaaaattagtcagacatggtggcgggcatctgtaatcccagctacttgtgaggctgaggcaggagaatcgcttgaacctgggaggcagaggttgtggtgggctgaaattgtgccaatgcactccagcctgggcaacaacagcaagactctgtctcaataaataaataaataaataaataaataacccaagtgaatattttactggaaaacataatacattagctttcacaggcatgtctggtactgtagagaaggaaaaccagatccttcaagtgagaaacagatgcttgagctgagtgcttctccaactagagaccacggagacttgcaggctgaagattctttttgagaagttgttgattttggggttgctattctgatgattacctaaacaatagtaaaaatatattctggatcatttgactggcttcagttcaaacaaaaactgctgtgaaattcagcctcaagtcagttcctgtgctttggatctctttgggagcaagtcatcatagtttagtttcctgaaatgagtgagaaaagagtggatagaaggcaagggaggcttcccctgccagtgacgtcccatggtctggggccgagtgtccgaagggtagagtcacaggagaagttgtgggggaagggaggcagcctacagctcagggtcccaggcctgctgagatggaacatttgaatctgggccaactcatcagggccctgttcggatcccaagcactgctttagtgtcagtaaaatgacagcctctggcgtattaaattgatagagtccatcagaatattttggtcttgtactttcagttatatttaattgatatgtttttatttgggccttctagttgtataagcataaagtatttatagctcagtttatatctagacacattgaagacatattgtcttaaaaataatttcattcggccaggtgcggtggttcacgcctgtaatcccagcactttgggaggcagaggcaggcagatcacgaggtcaggagattgagaccatcgtggctaatacagtgaaaccccgtctctactaaaaatacaaaaaattagcctggcgtggtggcgggcgcctgtagtcccagctactcgggaggctgaggcaggagaatggtgtgaacccggcaggcggagcttgcagtgagccgagatggcgccactgcgttccagcctgggcgacagagcgagactccgtctcaaaaaaaaaaaaaaaaaaaaaaaaaaaaaaaaaaaaatatatatatatatatatatatatatatatatatatatataaaacttcattcaaccttgggtgttttggagaattttttgtttctttacaagcggtcttttatgtcactcaaacttgagaaaaatggctttattttaatcctgcataaaataagaaacacaattttaaattagcttatcttcagaatgtgtattctggctgtctcctaagatacaagtgaaaggactgatgttgatgatagctcgtatataaacatctttaacagaagactagataattacttgaaacacctggtaggttcaaaaaaacaacaaacaagactagacacagcatagacttagatgagaagagctggaaggcggcaagatatttaagaagaccgtggacggctatctgcaaactgtgctcatcacagggacactagtgtgggaaatggccagatataaactcagtgtgaagatggggcttaaaaataacaaaactggaactgcaagacgggcccacagaatgcattcgcgtagggagacaggaaaacgttagcggagggggcggaggtggcagagaggaaaacatgggcctggcgaataaaaaccacagtactacttctggatttggagcaatagagaccatgtccgatccttccatgccctttaagcatcacctccctcacatatgggttcttctgcattgatttttggtaaatctgcgttgactcttaatgactgcatattactttacgtaatgagtattcctgatgaaattcgtgagtaagcgctcacatgatttttttctttgggtgtttgatgggtgaaactggtatcaaactcactgcttttcaacttttgagattcaacttttcctcattctgaaaagttaaaaaatcatctccggaactctgaactctttattgtatctcaaagattcccggcagcatctctgagactataatagaagtgtttggacatctattggcatttaaaatatttgtatatgccatattatgtcatcatttttcttaagcacaaggttctccttaaattgttattctgtcctttctaacatgggacatattctctttgctcaagaaaacagaacacacaggaatcgagtagtgtttttacctactgacactgtgttagctttcttgacaagagcctattcttctctatcttttccctcttttcttgtcctggactccacttttaaagcccgtcctgctgtccttggaaatttaaaagagaatgtcacctctttccgtgccatcctcatgccgtgctcacaagtttgtgctcttctgtcgtgtttttcctctagttattaaacccatcactcaactgttgcctgtgttttctaaaaatctgagctcattggtgttcaatgaataccagctttttggtgttaaaaatgaataagacaatttgttaaaaagcatataaacacaggattgaatcttattttaaaggacaactgcgaaactgggctctatatttcaattagtatctgtaatcaacatttacttttattctgttgctataccataaaggtcattttatcatctaacggggaagctcctcaatgaaaacgcgtcacaaagttgtgtagcatttccacaaagtcactgacagctactgagaaaaagcaaccccaaacaaaacaaaacaaaacaaatacctttgagagattaactgagccataatgttttcagaaagctttcggtgaatttcctcaacaatcatgctgtaaagtagggaaaactcatttggaaaatatattccattgagaagcattaaaaaccacatgagtcttcgatcactatttttccttttaatttctttgcaagtcatcacaggagcaattgtgatatcctttgggttcaatggaaaatcgtgagcacccaggcttgggatagaaatggaaatggatttcagctctctgatgtgctcctggcactggtcacatgacacaaataatctgcaatttgcagattgctgctgtttggtgcgaaacgctttgaggattaatttctctctcggctatagcttagaatccctaatgtgggcttgacaattacagtgaccttctatttcccccctaagtacaacttagaaaaggaaaccgactaacgacaaaatggcatcaaaaataaatgaagattcaatgtgatcgaagacaatgcagcgagactgaacactgacctctgagcacaagccagagagcatgggccacatgtgcaggctgggctgcagcagtgaaggaatccagtgggcggcttgctactccagctaagccaggttgattagggttgccatacactgtgctgaagtagccatttctgaattagtctgagagccaggcgttaataggatccctggaaaactcactaagctgtctcgacagagtaattgcattcagtcagcagcaggactttacagaatcaagtttaaagcattatcgttttcataaataaagccaagcttattttaatcctttctctctgctgatgggtttttatttataaaggattattcatgcattctttctccgtagccaatacttgctgtctcaagatatcctaagccagttaaggagaatcttgaagatactcaccttccacctaataatgtacttacaggtatacacacgggagagtaacttacatggttacacaaggagatatggaatagaatatttactgcgacatttttgtaataacagcaacaacaaaacgacacatctaaaatgaccatcaacagaagaagagataaaatcattcaacaaatagccattgtgcacccactttgtgccaggcactattacgacacttgggtcgcagccgtgaaaaattaaaacagacaaaaatccctcattggagcttgcattctaaaggggcgagagacaataaaaataaactaataagtaggtaaatgaagtaacattttggatggtcattagcactgtgtggaaaagagaaaatacaacagtataaagggcagggttggctaacgtaaaagtaagtgttcatttcttattgagaccatgacactgaagcacagatttttaggaattgagttaatatgagttagctagagtgaaatgtatcaaaacaggtaaatctcaaaatcataaagttgagaaaaaagttgcaatcgtttatgcacaatgcaatgtcatttacagaaagtttagagaatctattaaacaatgtcgatgcacgcaaatatactaagaatataaaataatgcctgcaaatgataaacgcccctgaagtatgtatcaaattgaagggaagaggaaagaggaacaggaccatagaagggcactgctattcaaatctgtcttaaagtgtattacaataattgttaaaaagaaaagctaatacttctatgatgcttagtaggaacaaaacactcttcacagtgttatgcatgtaattcatttactactcatgacaaccctataaggcaggtactatttttatccccattttaaagatggcgaaatcgaggcagaaaaagaactaaactaatgaagtcatcaaagccgggtagtgtgtacatggacattgattatgctactttaaatatctaactggatgtctggaacttttcataataaaaatctctagatgaaacctttaaagtacatctaaaaataaccttggaaaaggctgaataaaaattcaataacgtatagacctgagtttgtgaacatatatgagcatgaatgtagtctggagaaggaaaaccttccaatacaaccactaattagtagacataacttatctgagtagtatagcatgaaactttgtaaattttgatgctttcagaataagctgaaagaagccatgaaatattatctattcaatttcttacttgtagatgaggcagttaccagtccagaagatgcgaagtatcttttaggagctcagcatagtgtgtatgaagctcagatagctgtgatttcataatttatattaaaattgatgcagattggtattttctggttttttgcagctgctgtattaatccaaacatccttgctgggtcagcttctagtggctatgagactatccatcttccaatgaggtgccagggaagaatcagtctcattgataatgagacacgatcagaaattttcatttcacaaataatattatccttattggccggaggtgaattccaagtaaatattcattgattcttcatcgaacaactcttgagtgtacacttactatgcgtaacgccaggggccatagagaaatcataaatgaatcagacagggattctgccttcctggagcttgcagaagaaataagacgcacaccaacaaaccaagtagatgtagaaagagccaagtgagcagagagcaaccaaagaggtataaaaaaagaaaaagaggaggtggcttggaatcaaagaggccaaagcctggagtgtttgaggaatccaagcagctgcttggctgcagatgagaattgaaagcacctgcatacacacagcctacctactggggctgagaactgagaccactgagacctaattatttgttccagaagaattctgccctggaagataagcttgtaaagcaataaataacttcactgtttgcttcaagaaactcctgcaaataatttaaccagacagtttgctcatctgagtagccatctctcttaacaggaaatcagacggttcacctgggcaataatagctcttgtataagacaacagtttccttatgaaggcttccttaggactttgtctcactgtgtccactgaccccaaactactatgtcattgatctgctcaactccaatcagtttcccacttgaaagatctgcaataagcgcttaagcccagatccccaggctctatgaacaccctcccctgacctctctttcctgtgacacctccatgactgtccacacgatggtgtcacttcctgcactagatctaatcagcgctgctctgcaatagattttctgtggtcatttgggaggtttgagacagaggacaaggtagaacatgcagtaacaaaagatgaaaaacacttctcatttttcttatttgtatgtcattacaatgtcaaaacaacttaaatattttgaattgtgtgtatattcttggcgctttgccttcacctttgaatttcataaagttcttcctttgttattgacctatattttgagtgattgtgatgatacattttacagggcaagtgttttcaacatccagcatccctcagatcacaaatttaatttggctggtcaacacatgagtggccactgggaatgggaggctctcagagtgaaaagggatccttatccattattttctttctcctgctgctctcaaaagtttgtccttggttgacatcagagaaaggaaagggaggaagtgaaggagatggaattttgtgctctctttaatatgtttttccacagattatggtggttggttggttacctgagtgaaaatgtcaatgtctagttaacgttgggggaaagagaatctgtgggactgtcatcccccaagtgggtgtaaccaaaaagggcacttaggttaggcacatccctgtcagataaggcctagttaaatagggtctagagggtcagcggggcacctaattatcatggttaatgaggtttctttaggagaaaagaattctgagttccaaacaatgtatagacatgaacatttatggaacactcccctgtttataaactggaaacttgtgtaatttatatttgtaccctatacttcgccatagagtgtgctctgtaaactggccttccttgtagggcatgttcctgaatagggcatattcaggcactattaagtttgggaaaataaatcatatccaaaaccagtattaaataaatataagtcatcggactttaggaattgatgcaattccttaaatggaggaatttcttaaatggacacaattccttaaaaatgaggtaaagagaggggctgggggtaaagtggaatggggcaggggaacagaaaagagtttatagttttacaagtacttaatggtattttttgtttttgaattttgtattttaaattcatttcagtactttcccttgtcactttagttctgtgcatttggtttcttttattcatcttagcgtaggcataactgcattcattactgaaaggcatctttcaaattcttataaaaaacaaaacccatgtaagcactctaaatattgccacttaaattcatcactgcttttatatagcatccctgcttttatatatttagagtgtatatgctggggtgagatacatttgaaagagattatgaaaataaaacaaaaatccaatttaaaagacaactaatagcttctatgatgcgggaaaacccacacagctttgagtatattgttaattacactatggtttgattgcccagatctttgcattttatcacgagaattagtaattattctttattttaattagccaaaatgatgaatctgagcacgtctcatctgtcagagagttttaccaatgagctcaaatttgctatccatgttttgcagtgcagcatcacaagtgttcaaccaggtgcctctaaaacacgagaccttgagccttggtatgcggctcaggtgactgcaccatggccctggtataagcaattccagacagttaaatccagcccttcatcctgcacacttacataagaaattcatttatagacaatttttttgttgttgtttgtttgttttttgacacggagtctcgctctgtcaccaggctggagtgcagtggtgcaatctcggctcactgcaacctctgcctcccaggttcaagcgattctcctgtctcagcctccccagtagctaggactacaggcgccctccaccatgccaggctaatttttttgtatttttagtaaagatgggatttcaccgtgttaggacaggatggtctaaatttcttgatctcatgatccacccgcctcggccccccaaagtgctgcgattacaggtgtgagccaccgcacccagcccaaaaatttgttttaagcaagcacttatcaactagaaaatgaagctcaatagacacggatatcgttggtgtgtcaaagctgaagattatcctaggaaaaactttcatctatctgtgtttgtgtatttacaacttcctctatcatccagacatggtggctcacacctgtaatcccagcactttgggaggccaaggcagatggatcaccttaggtcaggagtttgagaccagcctggccaacacagtgaaatcctgtctctactaaacacacacacacacacacacacacacacacacacaaaatagccaggcgtggtggcatgcccttgtaatcccagctactggggaggtttgaacctgggaggcagaggttgcagtgagccgagattgtgccactgcaccagcctgggcaacagagtgagactctgtctcaaaaaaaaaaaaaaagtttctctatgtatcaatttttattttaagaactttcataggcatgagtaaagctactgcagtgaaagaacctgtcaaaggtcatttcactacttctgtgctgtccttttggtctaagttcacaaagtgtttgtctccattgtatttgctgtttttgtgtttggttatttagtgactttaaaaatgtcaattaactaccatgcccaataagtacataagcaaaaggagtttttttgagaagtgttgagagagaagaggcctggaatctaaaaacacagataatgtgctgaacggaagaaggtcacggaagaggatatgctgaagtctgaggtttgagtcactggacaatcagaagcaaagacttacttatggacaaggtgaagggcgttgggcctatgtcatcaacagtgagcaagagacaggaaatagaatggaagaaatgaaggaaaaatggaatcgctggcctgagaatgaacatcagcaattggtgttgactcagaaggctgagattctgtttgaggacttaaaggtgagggatgggaaagtggtcctgccgagctgctagtgcagagggtgtggaagccatgctaagctagtgagttctgacaagggctcctttcctgcttcaggttttatcacccactcaatatttactgcgcagagagctgaggacacacattaatgaaacagtccactcttcacagtgcttagggcgtccttcgctcatacttctttgaacatatccactctcttgtctattttacattataacacctccagatcagagaaggagtttttgacttaacttgttactccccagctcaccgtgcccagagctccacgcatgactgaatggtgaatttggaatcattgctttcatctactggtttttaccaaagtgtaaagtgcattttctaaatggctctctggctcacagaaagtaacagttttaaaggagatattttaaaaggtagaatttccaatgacaacccaattctttggataattcgtcttattttataatagcagaaacattcctatatgagaacaccaactcttgttaaaacattgagattaccttgaaacaatttagagtctctaaagttgaaagttcttctttgaagatctatacattacaatgttgggcgcagcagatataatctgaactaggaaagactgcatctgcagactattattattattattattattattatttttgagacagagtctcgctctgtcgcctaggctggagtgcagtggcgcgatctaggctcactgcaagctccgcctcccaggttcacgccattctcctgcctcagcctcccaagcagctgggactacaggcgcctgccacctcgcctggctaattgttttgtagttttagtagagatggggtttcaccatgttagccaggatggtctcgatctgctgacctcgtgatctgcccgcctcggcctcccaaagttctgggattacaggtgtgagacactgcgcctggcctgcagactattattaattttataataaggataaatgaaaccagacgtaagtgtcatacatgcatgaattgagttcagagctgtcgtcttatgactcagatccatgttcacccaggttgggaagctcaatgctgcatccatgtagctgatcccagcataggcctgacataggaaaaagactatgggagcccttgtgccagtgactaaattccaaccagcatctttccagtgagatggcctattccaacacacacacacacacacacacacacacacacacacacacacacacacacatacacattttgtaagatcttgaaaaccataaaccaaaatagatccatgatttactggttaattttttgatgatgaactatagagcattaccaaaaagcctaaaatgtttttctgtttgactttcatgccttactttttttctttctggtgatatgatgtcactctgagcacacagggcataggttatatatagttcctttagattctctttaaaactttcaggaacaatgaaaaataatatatcgactaggtagcagttaggacaaatggtgttaagctgttctaaaaagacaatgtttaagctaaaaaacacatcttgggataagaaataaagaaaattcagttacataatggcactatcagggtatagcatcaaggcatatgtatttttctcttctcttcttagaagcgttggtgtcagattatcatttccaggttttttttttcctatttaggagaagttcaggaaatgcttaatatttacaattccctttttaaaggtgtttttcaaaattaaaatagctttgttttcattgccattataaaatattaaaatagttgagaaaggtagaaattagcaattttaccacccagagacagtcaccagtatttttttatgaatcatctcctagataactcattgcatgcccttacatcaatacacataggatattaaggatgttgcatcatactatgcatgacattctgtaacttgttttttccacctaataataggaatgggcatcatttcatgtcaaatgatacagacatacatcatcgtttttaatggctacgcacctttgcaatatccttgaggcaaaccctaatgatcatattggtgtcagtgagtcacctagacatgcatatttgcaaaccattcagaggcattaaattggacacactccccaaagtgcgactaccaccgggttaaagtatcgttccatttaacatttccatcattcctgccaaaacactcttcagaatttgtctacaaacttaacaccaccaatcacagtgaggccaatgtcccccagtttcccagagtattagagacacaaccctcccctccttggttgtatgtgtattcatctcttcttccttcctgagatgaagcttggcatcactccactctgaaagaaatgagaaccgtttttgcatttcaccttaatcagatcaaattaggacaggtggcaaccctgcaggcaacataattatgaaaaatgtctgtgctcaatacagcctgtccttccagcttcccaatcaaataggacaccagagcccaacctttctatttcagctggtgactcatagagcagtcacccacataattgctctgaatataatggtgctgcaaaatctgaaattaaacataatataaaaagcacaaaaatctattttgtaagattagttaatttaatataataatagttcttctattataatcttcatgtgccaaattgggggaaaaaaccttatggctggcctgttattagaagaaaatcttttaacatatcccccttacacttgccatccaaaggtaaaaagaaatgatgttgaggatttcctggttttattgtaagagagtagctgttgtccctccaataaaaagtgtgcaatgaatatctgtttaaatagatttgagataagctgaagctggatacaaaactccattatacaacagggggatcctacatccagcttcatttaggatattgcttctcagaagacatcccgaacacctcaataacaaatgttatattgaaaatgtgctcagtaacaattgcgggatgagtctctgtgcagcgatttttcagcatgtcaaaattatactatcacaccatggaaacaaattaaacagcacaagcctggctgccgggatggctgtattagcaatgcagtgctatttcataaagaatgcattgcttcagatctgtcaatgaatgtcaacaatggcttctccatttgtatgaagcccaatttgtatttggagaaaaaccaaacagaacacttcagaatctggttccatttcttcccaacatttagattaaaagaaaaaagcccggttatctaatttatctgtagtcagcgttccttttctagggaggcacttgggaggaagcctcagagtgtgagttaagcactaacattctctttctgaagcacacgggcaccattaaatgcttactgacagctcagagaaaacacaatctatgtgctacacattgtacaagaaggttttgttgatatattagattcatatatgtgagctttggttttcttgtatttgtgaaacgtggcttagctgtgtattatggctttttgtgactaatgagtgggtcttgcttcagaaatgattacagttatgtcagaataatgtcaaataatcagtattagtagatgagctcttagaaaacagaagccctcttttgcagatagatatgtcataccaaagagaaattaaaacccaagactattctaaacgccaaatagagtctgctatattcacatctcaaattttgtgtatctaacaattaagttaaatagtgattgtcaattaaatagcgttcaaattgtagctcaaaccgaataagaatttcttgtccctggagtggatgtatgtagacatcaacattttaagacacaaagggatgatgagtttcaggctttgttgcagaagtttggacagccgtttggctcttccctagcagtcctgaaacacatgaagtaggtggtcctcctgcctcttgcctttttattttctacagctggctcgattacagccctgaggacttgacacagcagaagacaacccagccaggcagcaggttcaatacacagctgaaatctcactgacctctacatatttggctccagtaacctcttatgtatgtatttattttttaagatcatgttctcagtctccataagggtaaatttgtaaggaagaatttctttaattgtttttccaaacatgcaattctgtgcctcaatcgcttctttttttaaaaaaaagaacagttagggtgtcactctgtcacccactgttgagatcatagctcactgcagcctcaaactcctcagctcctgggagcaatcctccctccagcttcagcctccagagtagctaggactgcaggtatctgccaccatgcctagctaagttttaaattttttatatagagacaggattttgctacgttgcctaagctgatctagaactcctggcttcaagtgatcctcccacctcagcctcccacagcactgggattacaggtgtgagctactgtgctcaacctgcacctttggttttgtcactatattgccatagcaaaattcaggtcagtgggacttgagttttggttttctccactgagttccacgttcttgctcacgtttactccagctaccctggtgtagaaatgaaattaccccagtcctcatgatgcaagcgcttattctgtgccaacaccttaagctccgtttctaaatgagattttgtgaaacgaatcaatcaatcaatattaaaactcaagactaaaatctgtctttgatttttgttcttcctactgctatttccactgaaaaaaaaattctctttcatgtgtccatgggtagaatatccttgcattctttctgttgaaatagtatggttctagtattcactagctatgagatattaaagaacggaagccatcttcctcattatgttttataacagagaaatataactccccaatttacatctaagttcatcttaatagtgctttatacaaaaagttcctgaagaattacaacagttggccattctgcaaagtgccaagggactgattctgaatccagagcaacaacaaccaattatgaagaaatggtctctgtggctagtatggtctagacactagcaagctacatataatgagactgctctctcctttcaaaggctgtgatttaaatttataggtggggtcaatgggttaattttcactgccttgttttcactacacttaccgctattgaggggccttaaaatagctctgctatcagaactcactaatccaaatcagtttataaaaacactctcagattaacaaatcaatgatacttacacaccacaaaattggttaccacttaaaggctttattctgactagatttatagcctgcataaatcccattctcatgtaatttagatggaagacaagcaagaggtatctctgctgtctactcacagcagtgtaggccaaaaaggagagcgattctttattattgatgtttagcagcttgtgtttaaaagctataaagaagacgcaatgaaaatacaatagatcaattcctaaatttccagtatagtttacaaaattttaagagggattaaggatgctagtaattaacttaaaaataagggcatcattatatgtctgtgtaacagagatcttttcagaaacaaaaaatcaagatttttttcttttccaactataaataaagcaaagcctgtttcagataaaattcatctgccaaatactttaatgctatcctgaggttaagaatgatgaaataagtttgatcattcttatggtaaaatgaaggctatttaaagatgagtttcattcctgctttttttttaaaaaaaaacttttatttctataagtttttgggaaacaggtagtatctggttacacgagtaagttctttagtggtgatatgtgggattttggtgcacccatcacccaagcaatatacaccgaacccaatgtgtaggcttttattcctctcattcttgtttttttaaaggtgttttgaacacataaaactcactgtatctaatatattctgagcattggattctagtaacatcacctcttaagatgtaaaatctcttcattttagtctctgttgagaattaaagactggtaaaaccagtaatgtttttagaagcatatattgctgtctgaacttgggatttctgattcaaaattcagagtaaaattttagctcttgggactgctacagaaatattctataagcattaataagaccatgtcaatagagcgttaattattaggattaaaaatttactctatggggggctgggcgcggtggctcatgcctgtaatcccagcactttgggaggccgagtcgggtggatcacaaggtcaggagttcgagaccagcctggctaacatggcaaaaccccgtctctactaaaaatgcaaaaatcagccaggcgtggtggctcatgcctataatcccagctacctgggaggctgaggcaggagaattgcctcaggaggaggcaggttgtggtgagccgaagaggcgccactgcattccagcctgggcaacaagagcgaaactctgtcccctcgccaaaaaaaaaaaatttactctatgggtatcaataatcaatgtgttattctaactcattctgtgcctcattcagtaaaaggctatgaagcaatttaaggatatttgcaacaaacaagttggtttgctggtgttgctcttgctttttttaatgaagggaagactggaaaagggaaagtgatggcaataaaagtaagggcaaactgggaggtggggctggacctctcggtgcataccgtaaagccccatgatactgatccatgtgagccaccaacttggttctgagtttcccagcaatcagaacaaagagggcaccacaatccctagaaaatacacccaaagtggtttttgagaggacaccatcatctctagaaaataaacccaaagtggctcttgagagaaggacagaacttaattttggcacaagcctaggactgccagatttagcaaataaaaatacaggacacccagttaaatttgagtttcagtaaagtaccaagtcctttttttttagcctaagcctgacccagatatttttgttaacctgaaatgcaaatgtaaccggtatcctctagtttatctggcagccttaccaagccataattcagagagaatatttgtaacagaaggccatttgtagcatgtagttttagttcttggtttcttaaggaatgactagaatgagaaatagtatatttcctagaaacaaaagcttctaatttcaacaacatcaggacatagtatacggcatgccgtcaagaaacctgctgaaatacaccagcagatctgagcaggagcaagtgctgcagaagccagggtaaggaggacgcgcagagacgccccgctgctgagagcgcctgtgcttcagggtccactgcaggtctgcacaccacagggtgggtcacacctgagacgcccgtattttaattcctttctcccgtaaagccctcacctcactccactctaaggatttagtcggtgaaaaataagattatacttcagacaaggttcaaccaaacatcatcaaataaacctattctaagaaatgaggagtatctgtattcgatggtagaagtttgaaaggaaatacagatttttttttttttcctttcaaagagcttgttaaatttgatctccctcttcaggtagataactcgtggtcaaagttttcaaaagtttcgacatgtaagaaagaggaaaatacatgtaaggcacacaaaaaccatctattttgtgtatgtaattccaaaggattttgcttctttcatggaattgcatagagatgtttgtcttattttcagacactgataagccattatcagtatcatctttacctgtgcacatgttttttgttgaatttcctttaaaatacaatgaattgaaaaggattaaattcttttttttttttttttttggagacagggtcttgctctgtcacccaggctggtgtgtagtggtgcaatctcagctcactgcaacctccacctccttggttcaaatgattttcctgcagcagcctcacaagtagctgggactacaggtgcccgacatcatgcgcagctaattttttttttttttgtatttttactagagacagggtttcaccatgttggccaggctcgttttgaactcctgacctcagatgatccacgcaccttggcttcctgaagtgctgagattacaggcgtgagccactgtgcctgggctagagtattaaattctgaaatgcaattataattttatttaggatatattttacatctaattaaataaatatcctaaaattagcttcacagtggagaaacctgacggccaccactttgaccaagtaatccaagttcatcccaccagtaatgggacaagctgacactgtgtgcctactgagaagggtacaacatcctcctccaacactcttgccaaaaatgcataacttggttgggtacggtggatcacgcctgtaatcccagcactttgggaggccgaggtgggtggatcagttgaggtcgggagttcgtgaccagcctagccaacatggtgaaaccccatctctactaaaaatacaaaaattagctgggcgtggtggcgcacgcctgtaatcccagaactttgggaggctgaggcgggccgatcagttgaggtcaggagttcatgaccagtctggccaacatagtgaaaccccatctttactaaaaatacaaaaattagccagatgtggtggcacacgcctgtaatcccagctactcgggaggctgatacaggagaattgcttgaacccaggaggtggaggttgtggtgggccaagatcatgccactgcactccagcctgggtgacgacagagtgagactctgtctcaaaaaaaaaaaaaaaattgcataacttgagtctaaacaggaggaaacattagacaaacacaaattgaaggatagtctacaaaataactgtcctgcgctcataaaaaattccacagtcataatagactagacataatagtctagataagaggggtctaaagagatgtggcaactggatgcaacatgtgagctgggattttcttcttactattaggtatgtactgaggataaattttgaaatttaaataaggtttgtgtaaagtatggcatcaatgctaatttcctgacttcgatcattatactgtggttacataacagattactccggtattgagaaaacatattctgcaatcttcagaagtaaaggaccatcatgttggcaacttactctcaaaggattcagaaaaaaaatatatgcacatatgtacacagatggagacaggaagaaacaaatgtggtcagtgtcagcatgtgggtatctagttgaagaatgtatgaaaaattctttctcttgcaccttttctcatgagtctaaaattacgtcaaaattagaaagttcaaagaaaaagacatttcctttggtaaaaaaaagtcactcagtatcactaggggaggcatccactttgttttaaagcttactgggcctgaaggaaatgacactcgaacagcacagccagctatagctacagcacagaaaaccacctccaccctctcccacaggagggctccccggctagagttttctgaatacttactggatagttcaatgttgtttttttgtttgttttgtttagctttgccttgttttttgttttttacagctgagaaaatttgagtttccacaacatccacagacaatctggaccataatcaagtcagtgcagtctaaagcaatgtttcaaatatccgaaggtaaggccagttctttattttttgattgctactgaaactaattgaatagtgttatgaatggagtcaaatgatgtgcttaatcaactgaatatccaataattctgtacagcctattctatgttagttttctctaactataagatattctaatggagaacaaggaaaggaataatgccatttttacccggccctttagaagacaaggtaaactcatcttttctaacaggatattgaatatgcattttttttttaagaatccaagccttacctgtacggttgtcccttggcgtccaaggagtattgattccactactcctttgggatgccaaagtgacaattgctcaagtctctgatatacaatgatgtagtatttctatataacctatgcacatcctcccatatacttaaaatcatccctagattatgtatatctaatacaaagtcaatgctatgtaaatagttgttatattgcaattttatttgtattatttttatcgttgtgtcattttttatgttcattttttccaaatattttctatctgcagttgggtgactcctcagttgtggaacccatagatacagggggttgacagacactaggttgaggtaatgcttcatgattgttgaatgtaggattttggatatgcagaaacgaatttctaccttaaagactgaggagcaaaatataaggagacaatgcattaagcccatctgttaattttgattagttttaatattctctttaatatactcttctgtttatataatgtggggctagtagacgaaagaatatcaatatcatttgatgatattaatgttctgattatgcctatattccttctacaaatatatatggcacaaaatccaaatgccaggaactggtctagataagaggaatacagacgattagacacagttcctatgctcaggggatttacactccactagatgatacttaagtacacaaactaaagagagaaaaccctaagggctatggagaaagatgaagcagggaaactgttggagggagagggaggatctggaacatcagcaaagtcttcactagggaggtcccttgtgcagaccaagggacagccaggaccagcactaggaggacgagggaacacaagcagagcagacaggtctgcgggccagggtgccgccaggataggagggctggcgggagaggcaggaggtcaccgcaggacctgaaggaaatgactcctggccaggggccagatcgtgatggtctcaagggttgaagtttaattccgagagtagggagaaggcactggaggacttgcacatggtagtgatgtcatagccttcatattttagaaggcattctacattataataatgtgagatttacagaagagttgtaacgactgcacagagcgtcctcagatgcgctgcaccccacgtccgctgctgttaacatcctacataaccaggccatcttcccataatcctctatatttaaaaggtgatctgtccccttactgtatagaaaataattacgaactaataataacgacaatcattatgaactaataacatcgcatgtcaactgcatcccaggagctgttccgagtgcttcgcatggatcacctccttagtccttacgggctgctttgagtgtgagggcagggctattgatattttcattatccccatttaatggatgaggacagtgaggcagggaaaggtgcataaacctgcccagtgtcacaaaactaatatatggtgaggctggtttcaagctaatattggccaatccccaaccctgaactctggaatagtctgggggagcaaaacaagatccagggagcccagttaggaggctctggctgtggcctgtggtcagcagtgcagcggtcaggtgggaggtgatggcacctgggggctggaaggtgaggccagcaggtcttgctggtgggctgccctgtggagcagacaaaggaaaaggaggcaggggttgcgctgccacttttatcctgaggaaccggctggacagtggtgccttctactgagagtaggaagactggggaagagcgagagagggctcgaggagttctgcttcggatgccacattggcaaagcttataaattatccagttgtagccaagagaagaaggtgagtgtttggagagtagagagtgacacaccaagtcatgatgctcaggggtcaaataggtggaggtgatagaattgactgctggaggccgggcgcagtggctcatgcctgtaatcccagcactttgggaggctgaggtgggcagatcacgaggtcaggagtttgagaccagcctggccaacatagtgaaaccccatctctactaaaaaaaaaaaacaaaaaacaaaaacccagcagggtatggtggcgcatgcctgtaatcccagctacttgaggggctgaggcaggagaatcacttgaaccctggaggcagaggttgcagtgagccaagaccattctactgcactccagcctgggtgacagagcaagactccgtctcaaaaaaacaaacaaaaaaagaactgactgctggacttcatgccaaatctatttacaaatcaatttaacactcttcaagatgtagaaatcaacaaaaattggttcatcaattttctgtcctcagcctgtctcctcttcctcccagatccccatcccagctctgtcttatgagagaaacaaggaaagagagaaggaaggaaagaaagaggggaagaggctgtgggcaagatgggagaagacatcaagaaacccaaaggcaaagaaaatgatggctttcaagaagagtggcaggccacacctcttccctttgaacaacaaattcatgtcacttctttccaatatcaagacacccgtaggacacaataatatattttctctcagatttttgttagaattcagtcaaactgtctgctttagaatttattatctcatgacatgagcctctcattacagggtcacatatttgatttatgacatcaccagttaagttgtttctagtataacacttacacagttaaaatatataaatatttttacatagaagttatgaaatttcaagttgactgaataactgaacaactaaaaacactggtttttttatatttgaaaatgtaactacatgtgcaagaaaattataggtaataaaataatagtgaagaaaagaaaaaaataagtgaaacaagaaaataaggaaacaagtggattacaaaattatacattctagagaggaaaaacagtcaaatcagataggcagaagcagggatacctaaacgaacatggatcaatacaagttcttcaactacatgaacactggttgggggggtccccaagaaagcaaaatccaatggaaaatgtgactgtattgggtgggtaccctttgtgctattcaaaaggacaaacaatgccgtgagaaatctaaacctacaatgtaattgttgactccatagtgtgactataaagtagtgacaaaataattatatacttgtttctattgtgtgtcagataaaacagcacaaattcttgcacccatgtattacaagaacatcaaagaacacgttgtcagtgttcaaatacggcaaaaagttgagagggaagtttttctggtaatctctcacattcaacaaaccaccgacaacaagatactccaaaggaacccacagtgtggggcgagatgtaggaatttcatacacacagacaagaggcaggggagctatgttattcaagctcaagaaaagtatgaaagtaaaggcttctgttatgacactgggttttacctgctttcccattgttgtgttacaaaccaccccttactttttattcttttcacaatctctttccacgcagacactccatgtggttagcttggacttcctgacaacatggtggcctcaatgtatctggatttctcatatgaaagcccaggactcttcacgaaggccaagacggaagctgacagtcatgtcaagagctaggcctggcagagtgtctttttccactgaactcagtgcaagcagggtgaggtcagcccaaattcacagggcagggaagtagaacctacctctcattgggagggggatcacattatttgcagtgatctttactatgccacagggttgatcacctttatggcaatttgattgcttatcagccaaaaggaaggaggtggtgctataatttacggcgggaaagtgaaaaaagaaagaacattcctgggtcacttctctaggctgcctctgactaactccactgacaactttaaatccacatcagaggttgcatttgaaacagaaagacaagaaatacctgcaactaatgttgtcctgtggagtggccggtggcaggggacagctgaaagatccacacagaaggacaggggacttgcagacatggggtcggggtgaggagtggggactgcaaggagactgacagcgtggagctgccagctgtacaaagcttgctatacctatcagggttgaggactcatttttgtgtttcgacacattcttggcacgttccccttgagcatgaggcagaacgcaactgcctttgcttattttatctagagaatgatgaccaaggtgctctttccctaaagagaaggcagaacaagaggagagaaacacattactatggttggaggttaaaaaaaaacacttttctggaaataaaagttattcaccactaaaacagtttacacctaaaagtcagagaatcacttatttggaagatttctatctttactagtgcttattgtataggaaaacaactatttaaacaatactcttcacaatatgtatgtttttctttttctgacattgttttccaactttggtttgctattttttccctttattcctcaacttgtctcccacttctcagcctccattcatgtctgccttgcctttcacccaccagtggtcccagcgatatcgacaagaaacccctaggaacatttagcacacacaaaaaaagcctactaaatcccttcctggtggtccctatgctcataattaagtcggtgcatttctgtctggaaggagagttacactagattatttttctgatcatttaagagctagtgcccattagttataacaatggttgtaggagaatgaaagtgctgaccaactcctatctttgcctacacaatagttctctacctctttcttccctgaagatgatttgatgcaagacctggcctgagagccttccatgtctcggcagcagggactctctgactcagagaattgatggctaatctcagtttgcctcaagaatcctattctccgtgtacagtgactgtattaggagtgttcataggacctagtcttggccaatgaaaagtaccgggaagactgctgggggcttctggggagtctatcacttcctgatacctagagagaaattcaaaagaacaagaggctttgggcctcacgcttttcttcctgtttggattccagggtgatgagatgttatcttgagctgcagcacctgtgggcatggggtgatgaacacatgccgaaaggaggagcccagggcttcacagaagtgttagctcctaaacagagccctcacctgccaacctctggacttctcataactaaacagcaaatgttctcaggtttcagacctcagctggtcaggttttctgttattgtagctaaaggaagctgtgctccatgaatattttcatatttcacatttctgcatagctagggcttattgagtaaggattactggcaacccaagttaaagaatgaccgaatggtgaacatgccttggaattcgagatagtgacttgttcctgtgacatgtaaaggctcatctcctctgcagccattcacttacccaggggtgacaaaactggggacctttctctcctttcttcagagaagattcttccacattcccggacaaaacttcctgccttgctgccctccacccccgactctctctctctctctctggagtggagaagggacaagtgtgacagttactctatgtaagctccaagtttcataattccagaggtcctctcctggggagaaagccctgcccatgcaggcacatgtggccctcactgtaccataccatgggagattagtgcatgaggtactggtgctgctatgatgttctgtgagtaaataaaaggtctgtcctctgatccagcgtgcgcacacacacacacacacacacatattctaaacccacatacacacatgtgtgcgtacacacagttagggtagttcatgtacctacttaaatgcatgcacaattctgtgtgtgcatttttcttagtgcagaaggggagaaggtcctatggttttaatcagattctcaaaggtgtcagtaatcaaaacaaaacataacaaaattaagaactagttactagagtataaatctcttgaggaaaataacattgtcttaatatctgtagggcctagcacagtgtttgacatgcagcagatgctcaataaaagcttcctaattgaatgaatagataaattagttgtgtggtcctccaactatgctcgatgcctagtgctctgggtgaaagaaacaagtatgtgacatttaaatacaaactcataagccataaactcatagaaacagatgtatacacgacaaacttgcatttatcagcatgaaagtctgataaagctctatattgagaaacattcaattgtatgatagcatggaacataattttgtacatccaaatgttaattataagagagagaaaagacctgtaaatgaaagagagagatcaccgtgagttatctacttaacatacgggcttggtcacattaagcattcattctgcatttaagcattctgaatcttaagaattttaatttgccttcttagcaatgagaggctggagtaaaaacccaaaacatatacacgcatatgatttctatattatatgaattttgtataaaacatgattatctttctctaattcattagctagtttatcataagcatccactcgatggaatgtgtttttcttccttcaaagcataagatacaggatatttaacaatatatgttacgaaagtatgtacagcagatagattagtaaactcttcttgtaacatacttcttccaactatcctttttctttggatgttgggtggccatggatgttatgggttgaatttactccccaaagagatatgttcaagtcttaaccctaagtaccaatgaatataacctcatttgggaataaaatctttgtagaagtaatcaaattaagataaggtcatgagggtgggccctaatacaatataactcttgtccttgtaagaagaaaagagacacaaagacacacagagacaaagccatgtgataacagatcagctgtctgagtgatgcagccacaagccgaggaatgccgactcctggcaacaccaaagctcagacaaggggtgggagcagatccttcccagagccttcagagggagctcagtcctgccaacaacttgattgcagacttcaggctcccaggacaatgagacagtaagttcctgttgttttaagccatccaagcttgtggcagattgttttttggcagccctaggaaactaatacaatgggtgacaatggatatattcttgtgactcagatcctgctagtgcaatgttgatttccatctgtcactatataaaatcattgacactcagatgggaggagacagatcaaaggagatcaaatcatagaaaatagaaggatctgagaagaccattcttttaacatgcaattgccacttaacctaaccaaaagatgtattttgtaacttatccttaagactattgttctgataaaaataacgtttctttagagttctgaaattcaagagcaaaatgattgcctcattggaattacagttgacttacatttgagacagggcatcttggacatgtcatttgaaaataaggaaggcattggacttccctttataccaggtaaactttcattaaattcaaccaaagcctggcttacagcaatttctgtgctcccatcagcttgaattgttctagctgtgtttggcagtgctgggatagggatggggtaacataatgatctctcgctagctacccagttttctatttctcatttgttcttaaaagcctcaaacactcccaaagtattttcttaaaaattgggctttcgtttatttttggaaagaaaacaatcaaatgttgatgggtgaggaatgtacagagacagcaacacagggattctcaaatgtttctgctactgggtgtctatgatgacaaaggcgagacccaatggtgcaattttcccaaacatcccgcacacgtgaaaacaccatgtttgtttcttcaaccacttctttaaaatctgttatattaacattcaattaatgatataatttctttttattgtacagttcattttcttagaaaagctctgggtattgaatccttagaagttccccaaattgctattttgaatagcctaatttttattccttacttggtattattatttcttctttctctcatccttttctgttatttctctaccccttttctttgtgcattttgatcagctagagttatattcttttccactcccagaggatacttcaaatcccatcaccctctctgaacggtcttccttttctatcctcattcatctgggtggacttcttccaactgcatcctcctgttcaaatccatgcttgcctgggatcacactgagtcagtgattctgatggtaattttttcaacaagcatttgttaatcattctctgtccaagtagtaggtcataataattagatactttaggtaagagataatttgggcccagtttctaccctctaggtatgtctttattgatatacccagacagtactagttagttagttaatatactccgtatacaatatactctagaaaattacggttctgttgaattggcatgcttttgttaatgcagattgatgctacatctccaacactaacctcagttaaactttttacctaagacaaggcatattatggggatatatgtgtgggaaagaagaaaatgttctcacctactagatgggtctttctttcctttcttatttcattctttctttcccttttcccttcctccctgattccccttttctctctttcttctcagaagacactattaaagcagctaagtcataatcttacaggtcagggcaaaaattagaaaactattcaaaaccactattacccaactcctagggaaaaaaataaaccaaactcctattaaaaaattcattacagttacccttgggaatcattctttcatccattcactcataattcatcagtgtatttattattgaaaattcctaagtgtcagcttacaacaaagtcatcctaaactatatgaatcttttctaaataatcaagactgtatctcaaattactcaacattacatttctaagaatttaccatttgacttcatattgaatatatttgtttttctatttatgtcttagtctgttcaggctattacgacaaaataccataaactgggtagcttagacaaaaaaaatttatttctcacagttctggaggctgggaagtccaagatcaaggtgctggcagatttggtgtctgctgaaggcttcttccccattggtagtgctcctagttgtgtcctcacttggtgaaaggggcaaacaagctcctttgggtctattagataagggtactaatccagtcatgtggactctgccctcatgatcttgtaactccccaaaggccctacctcttcatactatatcttggaatactttgaggagaattaacattaattcttctttaagtatttggtagaattcagcaataaggccatcagatcctgggcttttctttgatggaaatgtatagaaatgtctaatatagtggattttttttttttttttggacggagtttcgctctgtagcccaggctggagtgcagtggcgcgatctcggctcactgcaagctccgcctcccaggttcacgccattctcctgcctcagcctcccgagtagctgggattacaggcgcccgccaccacgcctggctaattttttgtatttttagtagagacggggtttcaccgtgttagccaggatggtctggatctcctgacctcgtgatccgcccacctcggcctcccaaagtgctgggattacaggcatgagccaccgcgcccggcatatagtggattttaagtcatcattatttaagacacaatgtatttagcaaaactaaaaactgttatttttttaacagggtgcatgtaatgctgtatttaaatatcaaaagaagctaattcaatgtgatgaagtaaaataattcgtatcacttgccatctttcagtggttgactaaagctgttatctaataaccatatttttatctaagtatatttaggggagattatctatctatctatctatctatctatctaatttgcctatcgatttacctacctatcttatctatgtaatctattttatccaatcaatcaatctaatcaaccaaccattcaatgtatctctctatttatctatcatctgtcttccaaagtaactttccaaacacaattagaatttgtgctatttctacgtatgacactgaatttttacatcaattacttaagctataaaaaaaaccttccacagaaataatcttactaaaacaaaactgggtgcaagtgaaattcaacaccggcttgtctcccagtagccttagcatctctgctataatttactgagagtataaaagtgctcattcatttggacttacttctgtttgttgcatagggcctgttagtcatgctatatttccttacaaaatgttaacattgagttgtccctcaaggaatattttaatgtgagagagaagtgtcaaggttagaactgctgagagatttgctctctgtagactgctggactgtaaataatcagccatctccagcatcaagtgattgctcaaaagataggatttctttctctgaacttaaaaatttagcataacttgtatttacttcatttcaacatttagatctgcatttcagagcactttaagaatgtgttggtaacttattaggccaatactaatgcagctcagcaaatgaatgcttattatgagtaaactaagaactctagggaatataaacaagatctaatccttgccctcaaagagcccacagcttagttgaggggatacataaacaaatatttaagtacagtaagaggcagactgataatggtactaataaagacttctgtttttataaaggtctacacagttttcaaagcccttcacccacattacttcccttgacctgaacaagaaatatttccagtagaccagaaagactgaatcatccttagtttagaaacaaggaaaatgagaatcacaacattaagggttggatccacattcataagcgtagcagcaacagtgctaaattgccgatttttttttggcaccatattgactatcttctgtgaaaataattaaatgggaggccatcagacagaggtggctctaaaaccccgggttcctaaatcagcaaactgaaatataactcagactcatttcctatgatcggctaatttaaaagatgaaacttgaactcagctgatcacaggcagtcaacttggaattagttatattgttctgaacttcccatgggaatcgtccaaataaggtaattgttcaaactttagccaattacataatttatttgcttccaaatttatcctataaaagctttcccttcaatgacctgtggtggagctctgaccacttgtggctagattcataaatcactgtttgcgcacataagctgtttaaaattttaatacgccttagtttatcttttaacacttctattttattcactcttccctctgtgttctgaaattttgttgacctctcttacctgacttttatcttctctctaactctttgtgttcttgtggacttacactattttaactccttccgtatcattttgatggggtttggggaagtagcagatatatggaacttcttcaggaacccatgtgggacaaaattatttccataagctctgggaatgcctcacagaggacagcaaatttgacctgggtctttagaaatgagtaagattagagtgagctgctgagctgaaagggaaatccaagagaaggaggaaaatgggagaagctatggtctgaatgtttatgtctctcatgagtgtccatgcatctcaattagtacccgtataaaacagccccttctactatgtgaggatgcataagagggcaccatctatgaggaagtgggccctcgccagacaccaaatctgccagagactttgtcttggactgccaagcctccagaactgtgagcaataaaattctgttgtttataagccacctggtctatgggatctcattatagcagcccagatggactaagacaggagacttttaagcccacatgataagctacgttaatatagagatcaatgcttttcttttttttccagggttgaaccttaaaaagaggtcaactatttgaaactaaacaagttcttgtaaattaaaaaaagcaccttcaaaacacagagacaatccagaccatttagtttaagacataactttgagcctttcagctagagcgggttttcaaagtaggagtcatgaagctgcctccaggaggatggcattctttacacaacagaaagcctccaccatggtgatatggatgggggtgcagaagacaaacttagcctccaatctactcggctaacaactccctaggcctttagggcagaacgggtggccagaatcgaagtcaaatggagtttattcagctggaggaagaacttgcagcatggttgctcaacttcaggccacggatttgatcctactttatagagatgagaatgagtctctgaatgcacagtgtttaggttagaaatctgacacattggcaagcatgaacggttcatgcctgtaatcccaacactttgggaggccaaggtgggcggatcacttgagaacaggagttcgagaccagccttgctaacatggcgaaaccctgtctctaccaaaaatacaaaaaagagccgggtgagctggcacatacctgtaattccagctacgcaggaggctgaggcaagagaatcacttgagcctgggaggtggaggttgcagcgagctgaaatgataccactgcattccagcctgggcgacaagtgagattctgtccccaaaaaagagagaaatctgacacattcttaagagacaccataaagggatttacttgttactgaaaatcttagattagcttttttctctttgattaaaaaataacataaattagaataaaatacagatttaaatttatattctattttattctatattttagagaaacatatttgagttcctcaacatctaatatttctgcattctcacagtatttctgtgatgtaatttttcaaaggatctgtgtaccatccacccctttcaaagctgagaatttcatattagatcattgcagctttggagaaaaatgcattaaaatataacagttcacattcttttgtgagaaaacatatatacagctatgtacccgtatgtgtatatgtgcatatatattacatgtacatatagaatgtacatgtgcacacagacacatatacatttacacacatatgtattttgatatttcaaatgctcaatgcagcatggccataggtaatagcaatctattctatttttagtggtagccatgtcatacagatgttttgacaccattgtaaatagcagaaaggggctgccctctctctttttttttttttttgagatggagtcttgctctgtcacccaggatggagtgcagtggcgcgatcttggctcactacaagctctgcctcccaggttcaagcgattctcctgcctcagcctcccaagtagctgggattacagacacgtgccaccacgcccaggtaatttttgtacttagtagagatggggtttccccacgttggccaggctggtctcgaacccctggcctcaagtagtctgcctgcctcggcctcccgaagtgctgggattacaggtatgagccactgcacccgtctggactaccctctctaaagaacaatgccaagcagaaattacaaccctctgatgagtggcatatagagaaaagcatcctatggtatcagccagaggagaaaataggggctctacagcaagatgcggacatgtgtgcaaacaccctgagccaagagtttcctcaggaaccaaccataagctctttgggggcctgtggtggtggtagtcctaggaggtggagatgggggttcgaggaaatgcagaaggttttgtatgtaatgaagtgttttcttttcatggacagagactgtttttctatcccaaaggtctgggggagccataaaaacattttagggaaaatgtcatcaattcctgttttagagtcacaatggcagggttggtgtgaagaacaggctgatattggaaggccaatgtggaagctgctcaactctccagttaagtgtgatgtgagcgtacactaaacacacagcaggaggaagggaggctgggagacacatttaagagctaactagtaggtagcattgagaggagttggtgactacctagatgtggtaaaagaaggagtctgggatgacttcagggtttccaattttgaccagtagggatggtggtgacagtaactgaaaaaagaaaaacaagtgttccagttccatgtggcagactgaacaaatgtgtttaaatctcctacttcctaaagcctgactaaaatgatattggtgcagaagggaaataaatctataaggacaaagagtttgagagagaagaaaaaatcagaagagagatgttaatcaaatcatagaacacagatggaatggtagaacctactgtatttagcagagcagagaaagctaaagcctcactgtctgcagaagggaaattcagtcataatcaaggccatttaggtgcagcaccaccggaaggcccaggactggaggatccaggtccctggcaaattcagagaaaagaaagggcccaaatgagaataagtacttgaaaatctcatacagtgagcagtaagatgacagcatcccaccccccagcctatgaagctggcaactttccctgcttccccaggctgaagacaaaatgttcttttcccagagtagccctacagagtggatctgggctcaggccacctggcacagcatgggggggagatgaggggctttattgaaatcagggaattacatggatgactgcatgttgattggtgatagctcaacccctttgttctgcctcccttccagactgacggcatccagatttaataaaaccctacacctccccaccactgggcaggacattattgtagactttctatctgcagttgtggagtcctaccaccctagaaatagtccagtgtttgggtgcaggtgtgccccttcctcacatcctgttcactgctctactacaggtactcaggtgaaatgcagaatttaacaagcctgaccttgcacacggtttccaatcagtttttttaaaatgcttttaaaaaaagtatgaatgaaaagcaaatgaagacaagacatctggagaaagtcttcagtaccaaaggtaagagactccaagaaactgaaaaggaaacagaaaacaatttagggaagagtagaagacttaaaaaaatcaaacacaacaaacactcaactacaatcaatttctttgaatagataagataatggtataaagaaaaaatatttggagaaaaagaagcggtcttaaatattaaaatgatgacggcagaaaattttaaaaatttagtcagtttggaaaacaagtttggagaaatctctttgaaagaagagcaaagaggtagaggaatgggaaacaggagatgggagatttaaagaaagaaaaacaaagaattgacctaacacgtttcatatccaagatgtaggaatcccagaaagagaaaataaagtggagaaaaatatcaaataattaaatacaaagatgtttcccagtatagaaggtcataggtttctggcttcaaggagccactgtataagtaggcccagaacaatgaatgaggaaggcctgagccaaggacagccgtcacagtgagcaaatggatgatgggctgggggagaacaggaacaagaatcagaatggccttggacttcagccaccagccctgaaagcttgaacagaatgccttcaacattctgaaagaaaatagtgccttacctaggtttccctattcccagacaaaccattgatctagtgttggggggacaatagagagaaaaatcagtgcagaataaacctggcattcgggacaatgtggacgacagtgccctccgctgtgctggagggtcctgacagcctcaggaggagtgggacctcagaatgcatgtctccaattggaaaaattggggagaaaatgatatgtgatttttcgtgattatactaagagatttataattctattagaaagtttggggctgaattaatgacgactttacccaaacccaagtgaacaagcaaatgaaaaaaccaagtcaatcactaaatccaagaaaaataaaatagttgtataagaaagggaattataatacctagtctgaacaatgcttttaatagaggaggtgtgtgtgtggatgtgtgtgtgtgtttgcaggcacatgttgtgtacagcattaaaccttcattgatctttcatagctagaatttagcagatagtagttaaaattaaagtaagaaaaaaatagctggatagtcatactatatttaatttttttttttttagacagagtctctctctgtcacccaggctggagtgcagtggcgtgatcttggctcactgcaatctctgcctcccaggttcaagtgattctcctgcctcagcctccagcgtagctgggattacaggtgtgtgccaccacgcccggctaatttttttttttttaatttttagtagagatggggtttcaccatgtgggccaggctggtttcgaattcctgacctcaagtgatccacccgcctcggcctcccaaagtgctaggattacaggcatgagccaccatacccagcctagaattttttatcctaagattcatcttgggctctttcactgatttattttattattattactataattaggctgcagcttaggttgtcatccaggtggcaatgttgtcacagttgtcattgcctgcacatgcccgtcaaacatacagaatagctgtcaggagcttagaagaaaattccaaagacagtagctgctcactccttaactaagggcagcatcttcagcactcttgcttgttgagagcatggtatttggaaaccatagtttctgaattatgggacataggtcccatatgtccaattatgggacaaccataattctgacactgcaagtgagctagctaggagattgcattttgaatgtgttaaaaatatcttaatctattttacttttaattttttatacatgtacaagggggataaataatgaaaaagtgtctcatatatttctactctaagagcacttttgataagtattaaatataagtctgagaaatttgaagtgatacaaagtctttcagagttcattaacagtgtttttttattttttcttgatgatgaagaaaatgatactgttttttagttcaatggcatcttaataactatttggtgaaactacaaaagaatgaaaagtgattctataggaataaggaaagtgagtagtttacagatatttaacactaaatgacaaatgtgaggtttctttgatgaaatattgaaattaaataacagaaaagcttctaggagatggggcttcgggcagatggttggcaaagttgagctgggcctgagatgataatacatgaactttcctttaagaacctgtttttccctattccaccaaaaccaaaacaaaaaaccctaagaaaacactgcaagtgaagatctactaacaggcaggttttgggcatggagattcagggcgaggtctgtgctggactcagcttggggagtcgcagtgcctgggggctggactacggttagagttctccagtcaccaagaacctgctgtttcactgaggaccagaagcacatgaaaggagaatgcttttccaatagcttcaaaggagtcgaattgttttgaataattagctatgagactgttccccatagtttacaaagaaaagtcattgatatatttttaaggtcatcatttgattcacaaaataagcaaaaaaaattttttgaatgaggcaatgactcagagtgcagaattattttatcattattcatgtaaaaagatattaataaattgtattatgtgccaagcactatgctaggaactcaaactgaattatttcatcaactcatcccaaaagcactaaggaatcattactaacactgtccctgtgtcacaaagagggcaacttgcccagcgttgcatgggagctggcctgtggtgggaaagtgggttctgactctgggggcaaagccgggagctgggatgtccgcgagctgcttctgaacgctgcccatagggagttatcttttgtaaggtccttcagcaccaccaaaatacgtacctctaaaaattacgggcaaaacagaaacagggcaggtatttcgttggttgattgacccacttatttattaatttattcaataaatatatattaatatataactaagaaaaatgtatatgtatattaataatacacacacacacacacacacacacacacacacacacaaatttaagaacctctatggaccaggcactgtgaggagtaccagggatatgacagtgaagaagagaaaataaacacctcaaacaacccaggatgttgtgttgcttgatattgggtgccgtaacaagtagaacaggaggagcaaataaaccagggaggcaatggggccagggtggtccagggaggatgtggaggaaggtctgggggaggctatcagctgtgcacagtgcccaggaaagaggatgccaggaggggcctgggcttggccggggtgtccatagcagagccaaggtgcttgtgttggaaagaagggtcgtccacgtggccagaggttgtgataggagaggggtggtcacaaggtgtcaccgaagaggtagagaggaatctggcactcacagatagagttgtttgaattttattctaattataaagggcagttactggagcattttgagggcggggataggatctgatttgcagctgaaaactatcgatgccctgaaacaggagcttgaagccttgttctcacgtctaaagccatccaaatataggggccactgtggtttttgtctggttttacaactcagttaatcccaatgaataattgagtacataaaatctattaattagggctgttaaaaaagatgtgatggaaagatgatcaatggaaccaccaggcgtggaaataatgtgagtctatgtgcgtatatgcagggcgagcttgagcttcacccaaaatctgtgggtctagaacttacttctctcttacagcacaggcacacctcttcttcttgtgtgtcacttcactgcattttacagatgctgcagtttttacgcattgaaggtttatggcaaccctgcatcgagcaagtctgttgatgccattttcccaacagtgtgtgctcactttcagtctctgtccatttttggtaattctcacactatttcaaacttttttgtcatcatcatatttgttatggtgacctgtgatcagtgatcttggatgttaccattgtgattgtttgggagcaccatgaaatgtgcccacataagagggtggactgaactggtaaagtgttgtgtgtgttctgactgctccactaaccagaccttcccctgtcttgccccttctcctcaggcctccttattccctgagtcataacaatttaagttaggccaattaataaacctacaatggcctccaagtgttcaagtgaaaggaagagtcacacaacttctactttaaatcaaaaactagaaatgattaagcttggtgaggaaggcatgtcaagttctagatctcttgcaccaaacagctagccaagctgtgaactgggaatgcaaaccaggagctattgaaggacatttaaaatgctactcctgtgaacacacaaatgataagaaagcaaacagccttattgctgatatggagaaagtttgagtgttctggataggagattaaaccaatcacaatactccattaagccaaagcataatccagagcaaggccctctcttcaattctatgaaggctgagagaggtgaggaagctgcataacaaaagtttgaaactatgagaggttggctcatgaagcttaaggaaagaagccacctccatcacataaagtgcaaggtgaagcagcaagtgctgatatagaaaccgcagcaagtcatccagaagatctagctaagatcattgatgaaggtggctacactaaaccacaggttttcaatgtagatgaaagagccttctattggaagaagatgtcatggagaagtcaatgactggcttcaaagcttcaaatgacaggctgattctccttaggagctaatatagctggtgactttaagtagaaaccaatgctcatttaccattccaaaaatgctagggcccttaagaattatgtgatatcagccaggcgcggtggctcacacccataattccagcactttgggaggccgaagcaggtggatcatttgaagtcaggagttcacgaccagcctggccaacatggtgaaaccccctctctactaaaaatacaaaaattagccaggcgtggtggcgtgagcctgtagtcccagctactcaggaggccgaggcaggagaattgcttgaacctgggaggcagaggttgcagtgagctgagatcatgccgctgcactccagcctgggtgacagtcagactccatctcaaaaaaaaaaaaaaaaaaaaaaagaattatgtgaaatctctgactgtgctctataaatggaatggcaaagacaggatgagagcacatttgtttacagatgcacatggtttaatgaatattttaagcccactgttgagacctactgctcagaaagaaatattcctttcaaaatattactgctcaatgacaatggacctggttacccaagagctctgatggagatgtccaaggaggtgaatgttttcatgcctgctaacacaacagatgaagggataatttcaacttttgagtcttattaagaaatatatttcataaggaaatagctgccataaaaagtcctctgatggatctgggcaaagtacactgaaaaccttctggaaaggattcaccattctagatgccattaagaacattcatgatttgtagaaggtcaaaatatcaacataacaggagtttggaggaagtcaatttcatccctcctggatgactctgagggcttcaagacttcaatgtaggaaataactcagatgtattggaaaccacagaagaactggaaatacaagtggagcctgaagatgtgactcaattgcagcaatctcatgataaaacatgaactgatcaggagttgcttcttatggatgcgcaaagattttttttttttaagttggaatctacttctggtgaagacactgggaacattgttgaaatgacaataaaggattttgaaaattacataaacttagttgatcaagcagtagctttgagaaagtttgagaggatcgactccaattttgaaagttgttctactgtgggtaaaatgctatcaaacagcatcacatgctacagagacatctttcatgaaaaaagagtccagtgatgtggcaaacatcaccgttgtcttagaaattgccacagccacgtcaagcttcagcagccgcaaccctgatcagtcagcagccatcaacatgaaggtaagaccctctcccagcaaaaagataaggatttgctttattgcagtgggctggaactgaatctgcaatatctctgaggtatgtcagtattcattttctactgccattataataaatcaccataaaaccagcttaaaacaatatccatttatctcatagtttctgtggttcagaagtccgggcacagcgtagctcagcttctcctctgcccagaatcccaaaggccaagatcaaagtccagcactgctctgtggggctctggagaagaacctgctttcaagctcattcaagttgtagcaaatttcagttttgtagggatgtaggattgaggtcccttttccttgctgtctacctggaggcacctgtactccctgcctgcttcacagccagcaggggtgtctcaaaagcttctcctgcttcccctccatctctatgcatgcctccacctttctcttcagccacatctctctggttgcttttaaggtctccaggggtgagtttggagagcctccctatttgaggtctgtgacctttatagctgtagctgcattcgtgtttaatggcataactagaggacagaatcttggaggaccctctttacaattctgcctaccacaataaatatttttagtgatggagacattattttaaaccaattcactgaggaccaaagagggctctattaagcaactcaacaacaacaaagagaaacagatttgagacaaacataatttaaacaaagctagaaaaggctttaaaacatcttttagcatgccttgcattagtaagcacatgtgcaaatgtatgccatcagaaggctatggtaatatctatttagaagtgcaccaccggactgaaatctagactatgttgagattgtatttctcaatatttctggtatagtaggtgtctaagacttcttatcagttatttaatacagacatttaaatagttgatattgtttcacatatatgtatagacactacagtgggaatgtctagttttataaaaacaaatctatttggtgccactaatacatgaaattttgacaggtggcagaaatcaaatgacatttacagaaattcaaacaaaatcttcgcttaatattactctcctttcccccacccttaatcaatcttgaaatgtcaggctgcaggcagccactgtgtctatttggaggtggatactgaagctgacctcccagaatttcctccttccatcccccttggcaacaacagcagtttcttatttttagttttctgggagaggaagacagagagagagagagagagagagagagagagagagagaacactgaaactgtatatttctatgagatgctggagtctgataggtcctttgaagaatgaagatgcaaaaatattaggttgatgcaaaagttattgcaattttttccattacttttaatagcaaaaactgtaatttcttttgcaccaacctacacatttttcttttaatgagatgataagcatatagagaggggtcttgaaacagctagatgccttttgtgttattttggggcttctaggctgcctttctgctgccccctaaccctcccttcatctcctcatccacacttttacaataaccccaaagctattattaatattaaggaccaataaaaagttggtagaatttagagagattgaaaatattttttatttcagtgaaagttaaatatctggtctagagaaatactcagggtataaatatgtcaatactttcatggctgttctcataaaactcagctccaaattttagctaggaaaaaacagcagagtgtcgatgaagagaagaatgaaatttcaggattcctgaatgaccactaaactaccaatgcatccaactatgttacaatagccacaagcaccggcaaacagccagccagccaaaggctgtggcagcaacgtgggctgccaggacccttgctccggccccatgccttgctctctttccataaagggggtcatgtgatacaaccgtggcaatgccacagggcagaatctgcagtgagttcctaaggaagcttttgcctccctctcctcctgcatgcaatggggagctgatggctgcagtggctgcaacgtggacctgactatgaagcaaagggggagagaactgcagacgagctgccttcacacaacatcatgaatccatgccaggaccacgtaccccgacctttttgttatgtgaggaaaatcaccctctctcgggtaagcatctgtagttgggttcgtgctgcttatggcctccaatagcctgaatggtaacacacacttctcaccaggactccctcagggtctcccgtctctcttctggccgctctctctccccagccctcctcctagctaccaccccttgctgctgatgcactgactttgatgctctgctgaactctcgtgtggcctgtcaacttgcctgaactccctgtcctgctctgttcatttttactccctcctgacacatagctctgtgtgcttctttatttggtagcctttgcagctcagagtaaaaggtatttcatttgcgaaagcaacacaacacaacaggtttgcctcctgctctccctgcaaggggaggggccggactcatcccatcccttttaaactttaaaccactattaggactgctgaagggaaaattagtgtgtaaaaataaaatgtccccagtgatgtgcacacccatttttccatgtgttcttttttttttttttaattatactttaagtgctgggatacatgtgcagaacatgcaggttcgttacatagatatacacatgccatagtggtttgctgcacccatcaacccgtcacctacattaggtatttctcctaatgctatccctcccctagccccccaccacccaacgggccccagtgtgtgatgttcccctccctgtatccatatgttctcactgttcaactcccacttacgagtgagaacatgtggtgtttggttttctgttcctgtgtcagtttgctgagagtgatggtttccagcttcatccatgtccctgcaaaggacatgaactcacccccttaaggctgcaaagtattccatggtgtatatgtgtcacatttgctttatccagtctatcattgatgggcatttgggttggttccaagtctttgctattgtgaacagtgctgtagtaaacatatgtgtgcatgtgtctttacagtaaaatgatttataatcatttgggtatatacccagtaatgagattgctgggtcaaatggtatttctggttctagatccttgaggaattgccacactgtgttccacaatggttgaactaatttacacttccactatcagtgtaaaagcattcctatttctccacatcctctccagcatctgttgtttcctgactttttaatgatcaccattctaattggtgtgagatggtatctcattgtggttttgatttcatttctccaatgaccagtgatgatgagctttttttcatatgcttgttggccgcgtaaatgtcttcttttgagaagtgtctgttcatatccttcacccactttttgatggggttgattttttcttgtaaatttgtttaagttctttgtagattcttgatagtagccctttgtcagatggatagagtgcaaaaattttctcccattgtgtaggctgcctgttcactctgacgataaatttctttaggtgtgcagaagcttcttttggtacttaaaatatttttagtactgcattggcaaatcaggaaaatgctgatgagaagaaaatgtacttgctccgttattaacaatctacatttcgctatacctttaaaacagactcattgaggttttagactcaattactgtaaagccagcatacagtgtatgggaccaggaacttgcacactgtgtgattaccacagagttttcagggaggaatataatgacaaactttagtgagatgggtttgtggtatttatattttttcttatttctttttagctaggtgtttctcatatccaacataagtggaggtttgaataagctaatagattatacaatagatttgaaggtacaaacatgttttacatatgaaatggcatgggatggggggcaacctattacaatcccaggaagccagtgccagaactgccaatcggaagatatggcctgggccttcctgttaaatcggtagattccttgtctattagaaaatgctttaatgtactcatcaatgaattacaacaaaggaaaaagactgtgagaaagtaaaatccttaaggctcacctaaatctgaccaaaatgtgcaggtagaaccagtgtatgggacaccaaacgggtgctgtacctctccacttccacactgaagcttggaattatgtatgatcataagaactactctgtgttcatgacaatttgcttaatcaatgttactttggatttactacacatgttctagcaaactgcaacatatatttttttcctatcgtacatgaagtgtttggtgtggaactttattttatatcccatgctcgttaattccctaagcacagctcccatttttcaactgctgctttgagaaaaggagttatttggtttgataatcctttccctctcctgaccttgttgccccaggatatgaacaacttcaataagcaatgcacaagggaagtactttgtgttttgcccggaaagccacagaatctttgaatgcaacagacactctctcaaggtaaaagactatgtccaaatttttttttgcttgcccaaatttttccccagcttttccttttctctctcacttttctttttccagaaaaataccaaaaaattaaactaaaggtttattctcagtattatgcccaaacctacctacaaacaatacatcaatataagactaattgtgcataaaattcaaattctattgcactgccgcataaaaatgcaaaatgctacagtggtataatgtctaatgctgagcccagttccataagagctgccccaagacagcttgtacagatgcaattatctctcacacactcaaactgctttctttcacaacattacttttattatgcaaatgtataaatctaattttaatccaaaagaccatctagaagattaaaaccgcactcgtgtcttactttcactaagtgtaattaaagatactaaaaatgtttttcactggaggaaggattttagccaccaggtcaagaaaccacaaagggcgccatggagctgccaagctgacttcgcattcatcttcattcttgagtggttctggtgaagcagaagtgatagaaaaatgagccacagtagcagcagttttcggcagagggcagcagatgctcttcacttggaagagacagaaagtcctggcagagcctgaagtggttctgaatccgccgggtctgaaaggtcattttgttaatcacaaaaaggctgaagatctacaaggtagcaaggacacagattgcctggtttcacagacatatggtcaccggcacaagaatttttggcaagcctgtaaagcaagcctttacaaaaactgtcttcattaaaaaaaaaaaaaaaaaaagagtgacgcaatctcgatgcccagagtagctaaggccaccatagggaaagtcatttgctaagctgctttttttttttttttcttctccttactttcctgttttactgttctatatccaggtaatggtagttacagcagaagttttttatttttttcaataggtctatcaataattgttacactataaacttttcatatgataaaattggtaataatgatatctatataacaataactaacatttacagggttcttacttggtatcagtttaagctctttgtatagatagttttattttaaatctcacagtgaccctgaaatattactattaccatttcctaaatgagagaactgaggctgagagagcaatttatccagtcacacttggtatgaagcagcagtagcccttgacttgaattggggtctctgagacagcagagtctagaactgtaccctccaatatggtagctgcaagccacaagtggttatttcagtgcgtctatgctgaatggagagaggactgtgaaatacatgctggattttgaagactctgtgtgaaatcagaaagtatctcaataatttttacatcgattacatgttaaaattataatattttggatgtattaggttatataaaatatattattaaaattaacttcacctttaatgtggctattagaaagcttacaattctataattgtataattggtacacattattctttttttttttttttttttttttttggagatggagtcttgctctgtctcccaggctggagtgcaatggtgtgatctcagctcactgcaacctccacctcctgaatttgaacgattctcctgcctcagcctcctgaagtacctgggactacaggcatatgccaccatgcccagctaattttttttttttttttgtatttttagtagagatggggtttcaccatgttggccaggctggtcttgaactcctgacctcaggtgatccgcccgcctcggcctcccaaagtgctgggattacaggtgtgagccactgtgcccagctggtacacattatatttccattggtcctgttggctttagatccttgactcccacgctgtacagcccattgtcccaagacaccttcttcctcgccattctcaggaaaatgaatgacgttaaggaattctgtaaaatttctcgacctgaaccttggtagttcctctcactgaattgatttgtttgataggaattatgtcggatgtaggtatcacatggaatggaaggaggacagaattcagggataagagggaagaaaccactactagcatcacctctcactgtgtagacaggaacatcagaggaatccgaatctccactttgcatcgacatttcctggacaggattacctctcaactttaagactccaacttctagagtttacatagattattggtcaggatagtaactaagggatccaatgcgtgaatatttgaacaacctacagtcatggaaggaaaatttttgttttgattcatctatgttaaaaaaccttcaagctcttcttggcaagcactgggccagagacaacgtgtctttggtttacagagaagtttccccatctttttcttttatcagcacatctctttcatttcaacaaagattctcaaccaggaaatggtcaccatggaaggcagtgagatggaggataggctgtataattccgatgactatccagggggattctggcaaggtgcctcctgtccacctttatgttcggtgcttcaagggctcacttgagtttctgcattcttctgttgatgcttaccatcaatgcccctgacagcctgggtgagggtgcaggggagaggctcaaaggggccagggttttgctgtctgtcatgtgccactctattagtcaggcttctccagagagacagaagcaataggatagatctttaggtagataaagatacatatatgaggggagatttcttagaggaattggctcatgtgatgatggaggttgacaagttctaggacaggccatctacaagctgaagaccctgggatgctggtcgtgtggctcagtccaaatcccaaaaccttggaaccagagaagctgatagtgtaattctcagtctgaggctggtgggggttgggtgctgatgaaagtccttgagtcccaaggctgggggtcctggggtcctgatgtccaagggcaggaggaggagagtgtatcccagctccagtaaagagaaactaatttgttttcctttgtttttcctctatataggcccccaggagcctgaatggggcccgtccacattaagggctgatcttccccttccccaatcaatccacttggactcacatcccaacctcctctggaaacaccctcacaaacacaccccaaaataacactataccagctctctagctattccttaatccagtcaagtcgacacctaaaattaaccattacagccgcacattttggttcataggaaagaactttaaagctactgatctagttaaccttgctggtcacccataaatgagaaaggatgtgaatcaaggaggaaggagacgtgctctacaacataggccacccacactcactcctagtatgttaccaagtgacaaattcacacatcacattccattgtagaaaaaaaagtcacttcttaatttcctcaatatctgatctcaccttccgcttaagccaccctctgtttttctccccagagaggatgccttaccacgtgtatgccgcctatctcagtatctgctggtgtaacgagcgcttttggtacctgttaggccccccgtctccaactcctcgcacctcctttccaaggtggtgactgggtcctcatggtgagtgagaggaggggtccccaggctgtttgcagatggggggctgccctctattcctcaccagctgctgcagtagtggtctccctgtcaccacctgctctggctgctaacttctttgaaaagggaaagttctctctttgcttagggctgtgtagcctctgaagatctggccgccattcccattcaattcctgggcacgcaggtctgccccgtaggctctgatggtaggctccgtttgctcagtagccagcaccaggcctgcccctttccagcgacctccctgcccctccccaggcccctaaaggaggttctgggagctgtgcccaggcattctctacctgaagccactgtgctcctgcctggccactgctgcagcccccagcaggaagcagagccacaagccctcacctctcatcctcccccacactctatgcagccttcttgtcatggacacaggtcttccctccaccccacagtccatgtgagcctgaaagagaggttctgttcctcttctgtctcttatctgaccagagctgccactacctcatgccctctcctgggattgtattaactttaggcttctgggaaagttgatttatgaggaagaggaagagtgagaaagaattggagaaacaaaagaaatcagagaacttgacaattttcttgttccttctgaaatgaattttcaaggtgacttattattctgtttaaaacactaaattctcagaatgctatgtacttcttggtgctaacaaactgaaaaagaatcacacctacatcaaacctatgcagtttggaaatcatctgctcttgtggctcatctgcgttgctcacttgtcttggcaaaagcatatctgagttggcaatgtctcttttcttttccgctttttcttaggctgtctatttcatgtgctatagctatttacaatagattgcatgagccccagcctgtttctaagaaaaagataatagaaaaatgtgtataaaattgtaaaaatacaatcatgtacaaagccatagttaacactcgagagcctatgggtgagtccactgagggcacctgccaagacccttaaccacagaagtctgagatatccccaagctgggactcccattactttccctattctggctctctggtgtgcttcctactatgatatcctagtttttctgcctctcttcaaccatgttttcccttaaaaaagatgtatatacagacataagtcttgtaagtgaatgcataaataatagatacaaaaaggattttattgtagtattccctagcaacacaaaaatatgggtatatacacttccagtgtcacattattcaggatgtctttttaaacagtataaatattatcctcaactgtaagcaaatatagaccagtaagggagcgacagacagctttttaaaaactgcttttttgaaaagcttatccaaatcaagcatttgttatctttttgcaatgtcaacagagctcttgaataaaatattagattatgcccctgctttttaatctgaaagtcatgtgggttttggttttgtcataactaccttagtgcctgtgtatactctctaacacccattattttcctaatgattttatgaaactacattggttttgcagatgagccaaaaatgggtaaaaaggaaagaatgaagacataagtaaaacagaaaacatggctttggctaagaaagcaccttttcttgcactgtgctttaatattcagtaaacatttggttacggttaaaagaaataagaaatatgtatgtttatattgaactggctaatttaatggctgctttgacttctactaaagggtcatctaatatttgataataaacacaacacattaatttttcacttttctttgaattacgggaaggaagtcttactatgaaaagcctcattatgaaaggcctcagtctggtctcaaatccgcagaaattatactctttcctcttgacatcttgtaataaataaaactgttaatattttgactttagacaaatttctcttttgctttcagcagctaacagttacaaaaagagacagtgccacattagttacagtaatttactttggggacaccagcagaaacacataaaattcattagtggcgccaaaagctatttccagttctaataaaaaggctaaactacaatttatgaaacgagtcttaaaactttcctgaagacagaagagttgagatgatctttggaataaccaaagcaagaatccctactgtacttaagccaaaatgtttgttttcacaataccgtaacataatgtgttaacattaaaatactttctcattgccaaatgaatataaactggggagatgctctctcagctcatgctcttggtccattaagcccgggttcctgcctctggcagtgtttcatgcttcaaagaaaggcaacaacaacaaaaaaaccttataagcaaaattagaataaatctacagctcttatgatcaatcatgcaaggttagcactgggagaaaaacacattcgcttctgtttcccataggaatcgcatgcctctgactttgagaccttgggaaatacattttcatcccacaggaaactcaaggttgcagatggacacacacattctactaatatcatttttatttaaacagtttggtctgataatttattaaaaagtgttccctaaaggaatgatgctgctactaaaaacattttcctgaattacttttaatctaaaaagtgcttgagaagaaagctggaagatacgatagttgaattcctacagaagccttgccttctattaataatgaacacaaaatatttggaaaataagacaatggaaataaattgaaataaacaagttggtctgcactggtctttcttagaatacattatgccattcaacacttcttatttagaaatgtctttttccaggaaaagtcctatgccctttttaaagtagatgactttcaagctactataaagacacatgcacatgtatgtttattgcagcactattcacaatagcgaagacttggagacaacccaaatgtccatcaatgatagactggattaagaaaatatggcacatatataccatgcaatactatgcagccataaaaaaggatgagttcatgtcctttgctgggacatggatgaagctggaaaccatcattctcagcaaactatcacaaggacagaaaaccaaacaccatgtgttctcactcataggtgggagttgaacaatgagaacatatggacagaggaaggggaacatcacacatcggggctggttgggggatgggggcctgggggagggatggcattaggagaaatacctaacgtaaacgacgagttgatgggggcagcaaaccaacatggcacatgtacacctatgtaacgaacctgcatgttgtgcacatgtaccctagaacttaaagtataattttaaaaaatcaataaaaaataaagtagatgatttctcaattatttcttctgcatataacccatcgttgaggggtaagcgcagaggagcaatgtggcggctacgtagaaccacttcttaaaggggagagtaacatctaacactcgtgctaagatttccatgcaatcatgtgcacaaattgccagctcagggctcagcacacaagtgtaaaatttaaaaatgccagaacatttctgctcaggcctattcataggccaggcctccttaggtttattgatacccttcccttagtcacaaaatttccttacaaagggcctgtggaatagcagttggaggccaaaggtctggccaccacctaataagaccccacccaaagtcatccagtataagaagttggtttcattacagtataaagtaaaattaaaggctgattaaaagcagcagtttacatctgtacatcatctgatctaatttcctcattcctgatgaggaaactgggccgtagacaggctaaacaaattcctcagaagttaagatcctatatgttcctggtgcggttcactgtgtattcctcgccgtgcacacagtgtcaggacagggcaggctccaactccttactgtttggtgaacgaataaggagggaaccagcctgttttggcgtaaccagcttactggctgtgcggctgttaggattcagatttcctgtggctttttactctctactacacttaccaaagaaaggatggttctggaaagcatcacagtgtgacacagatcaagtgcagaccgaactaccacccatgtgtacacgaacaggggccagtgactgatgatgcttcaggtcccgttagtgggcgccagtccttccttcaaccattaaagaaaaataaagggaacacactgatattttttcctttcaactgggtgcttgctgacctcagagtcctagggcacatgtggttgccagactgaaagaacacggagcgtgtctggaggatgccggcaaagctgagaagccaaactctggctgcatccactgatatttacagctttgccagcctaggctctgctcccaccactcttgggtcagacccgcagaccctggccaaatgatggatgaacaaatgcactcagacacagatatctagtgaaagagtgggttagggaaccgggccgcttacagaccccaaggagggtactgtaaagagtcagcagccacggctggctggtgccgcaggcatttattcagcacaaatttaatgacaaaggctttgagtcaacacacttgtggataattaacatggtcaccctccccccaccacccagagcagtcctgctcgcagacgattaaaggccaggttctggggcctaagtaaactcacttatctagatcagtttctttacatccccttgttacctaacctaagctcttaagagaattcagctgccttcagccaaattttctttagaagctttgcaaacccctggccttccaaggtttgcatctttctacaattgttcccaccaccctgaccaatctcctacacaccacaatatgcattttctcaaggcattctgctgaaggaggtacagcatcggagaaaagcctaggaaacagagggccccgactgccttatcagtcatgctaagatgatcttaccaataatgaaataggatctactattatgtgatctaataaagttatacttttttgataaataattcagcaaagtttcagttttctgaatcaaagggcaactaaagtacgtattattttctgaaagaactctacctactttaccagaaagagaacaccatggaatatggtacacacatcactgtgtcatgtgatgtacagccttggactttacatgctacttaaaatggattaaaaacagtgtttactataaagaacaagaggagtgtagcaagtgtcatcaaatgctttcataaagcccatcgccagacagtcagttacaaacactgagaagacctccaaaggtctttatttgtggcggagagttctaggaaagatgggtggaacccacaccaaaagacgtgctgctctttggggagaatgagtggtgtttcatgtctttagctgttgatatgtttgatccccaattcagggagcaaatggccacatcttttgtgtggaccccattggtgcagagatgagcctgttctatgactgcttccaatgcaccagggtgactaggataactctcagtgtatttctgctacatcaccttgcccttcattcagtaatgatacaaagatggaggttttcaattaaaaacttcacttaggaataaattgtgtttcatgggtttatgatgccctaaaatgtctctgagaatttacacttccttttttattttttattttttggcttgtgggtatttgctttgtgggcagctgcaaaatcggtattagccaaaacaaactgataattaaacaaacaaacatgatggtgtcatgtatcatgtcaattagagtaatgttggaaaatggaagtatacaatacttctaaatattgatttattgctctcctttttcttattctatagaaaaactagattaaaaaatcaatgtcatttacatgattttagtccaataaagagtgtaataatttggctgttcaattaatttggtttgaagaaatgagtgtcttagtctgctcatcctgctgtaacaagatactatagactggatggcttataagccacggaaatttatttctccaagtctggaggttgcaaggccaagatcaaggtgatggtggagtctgtgtctgatgagtgctgtcttcttgctgtgtcttcacacggcagaagggatgagagggctctctgagttcccttttataagaacactaatcccattcctgagatctctaccctcatgacctaatcacttcccaaaagtcccatctcctaataccatcaccttgagggttaggagttcaccatatacattttggagggacacaaaccttcagttcatagcagtgggtaaacatttagtgcttgaatatttgctagtgaaaggattaaattccaactagccaagaaggccacaagccagcctttgtagagaagtagagacatagcacttagaagagggggtctgacatctccagagctgcgccagctcttactgcagtaccgttcattgttaattaatgcattcactcattcattcaacagacagaatcgcgcagggctacatttggccctgtggggatgtagaggcgcgtaataggcaggcccttgaggcaggaagccaatgagagtgtaccatgcatgcagataaccagagtgctgagcaggcaatgaagagaaccattcgcaggacacacagctttaattaagtaatttatagttacgggaaatcttcaataattgatatcttgtaagtgggagctgaaacataatgggcaggcaaaggagtgcagaaggcagacacagagctggaagacactaggcactgaggaaaaccagcaccgaggaatggcgtcttcgtggagcatggactggatcaagggatgatggaagaggtggggaaggcaggctagggatgctcatgcatctgggctttgttcaggaagcaggacagactccttgaaggcgtttgctcaaaaatgggacctgatcagactggtgtttcagaaaaatgactcctgtagacatgaacagggtgatgtggatccaggagaagtttagggcaacgctctcagccagcagaatctaactgagaagcaagggaggaggtactgacatcggttagggtgcagtcaggagcgatttcagaagccgcactacaagcctctcccctgcaccccggcagttgctgcccaatcacccctccctttcacctcacctctcccaacccaggctccacattccatcagtcaccgtttaacaggcatccacatttagcccttctgcttaaaacctccactacttgacccgtgaagtcagattatccagtggtcacaaaaggcaccctatacatgactctgccaacctcccacctcctgtcttgcccttcccaggctggccctgaaccacggacgcttttttaatgttttccatcctggtattctcacccaaccatcctccgcactctcgctctgcctgcctccttccccacccacctagcaaatgccaatttgatcttcaggaagatgctgcacataagctcgtgctgaagaatccagttaatgtgagtggagcagacctaaaatcttggggcgatagtggttacctagtgacccacatctttgtgatttgctaatgctgataaaagctttgttgacaagccctttcaaaggcactctgcttccactctgtgacaatagcgccaggtctgagtctctagcttaagggtttgtgaaatgctttcaggtttttcactgaaggagttcacaagctttggtgcaccctgagttgagctgtgtcaatgagctcacatagcgttcattgtgcttacacacccacggtatcataataacagaagccttttcaattttcaatttgattgaatttcaccctgaaaaggcataggtttttactgtgtactagagtaagtcccactcttccttgggaaactcataatataatatgaaagcagagcctttagggtctgaaaaattgagctttgaaggtctgacaacacctaccatctacccaaggaactgccgagcacccaccaataactccctagtttgaaaacgtggccaatcagcgcaactctctgaggctcagcttccctgtagagccgtagatgagatgctttgaagtaactggcacttgggtgacacacacggtatgtccccaataaatggaagttaccattgacatagtttatactgtcatcataatagaatttcagaactgaaattaaataaaccaaatttatttaatttaatgagtttccaaaagcagagagtatcttaaatcttcctgtacttccaagaattacattgttttaagatgtcttttaaagcagtttcagaagtaccagtgtgttgccatttaccagagtcaaattcaaactttcacaaattcatcatctttaagttatggcgctctctggataccctctccgcaggcatccacggttttctcttgtcatcatcatcatcagtgaagatgtttgtcccccaccatgtctagggccctagactaggcactcaggaagagaagcagtgatgaatcaaaaaagacacgtggttctctgccagcaaagggcttgtaaaagaccacacagtgacagtcaaccacttgggaaagaaccacatgacacaggaagttcgagtgtctaaatacaaaaacggttttcttccaaaatgttagtcacagataaaataggatacagacaaaaacaatcctttaagggctgtttgcatccccaggggtgtttgcgggcagcactaccccagaagggtggggccacgctttctaggcaggctgctcctgctaccctcttggaactttgtgctcccagccacagccatggaagaggaagagagggtgggagcccagcaatggttgattgggggtgagtacatcagaataactctgccgtagcagacaggagtgcccaccatgtgccatgcatgagctagtgcttactgaaagccttcaacattgtgggattccatagatagaattttttctgagaaacagttttctgatggttgtaaaggaaacaaattctttaccaagcatttaacatctgcaaagcactagagtaccaataagctctacaagacccgaaatacactagagtaccagtaaatcatgcaagactcacaagtagctcagtcagactggtaagagacaagacaggagaagagtagctttgccacgtgttttatgcaaagtgtcaagtgacaggtgcaacaaatccatggcacaaatatcacaggccctcaaaagcaatgagtgtaaatagaaaataaaataatctggaaaaataattgcctatggcataaggcatcttatttatttaaaaatgtatccatcataatatgaggatgacttcaggctatgaggaatttattggacagttttcattcaatggggagataaaaacgctttttgaaatgtcttgctatctgtagttagaggaatatcctcctcttcttacatttctatttcattttctatatgcagttgctaggggtacgcacacacccagacaaacacacacacacacacacacaccccacacacacacattcctcagggctttttattcattggaaatttgccatagctaaacacagccactgaaataaaaacatatcctgacatgcattcttacccaatttatcccatttaggactgtagaaagtatctgggaagaaaaactaataaaaaaatgtgtaagtcgttaactatttcttgttgagttcttttccccccagcagtacattaaaatggtctgtacaaattgatagcttcagcattcaaagtgcattaaaataagccaaaccaagactgtgcaccaatgtcagagagcagctcctgtttccaattaaaagagactttccagtggaactgatgagtcatggctcaacatggcagagaggtcttatttatttttttcaaattttctttttagttttaatgatagtcacagcgtcacacatttttgttcattagcatagatggggcctaaggttacaaaagctgtggtaagaatcgtccttaattgcaagggttattctaggatttacatgagaaaaaaaaccccataaatggcaacccaggcagacacaggcatctgtgagcatcttataaaatatctgtaactatagtgtaaatggcaaaacgttatctagtcttttacttaatatgacatttgggtgaaattgcatcttgattcatttgatcttgctgtttttctttaatatgaaattagaaaaaagtagtttcacttttgtttttagtcacattttgaaataatagaagtcaaaataaatccagttgtctgaaaaatgtatctgtttctaaatattctataaaccattggaaactgtattagtccattctcacactgctaataaagacatgctcaagactgggtaatttataaaggaaagagatttaatttattcacagttccacagctctggggaggcctcaggaaacttacaatcatggcagaagggaaagcaaacatgtccttcttcacacggaggcagcaaggagaagtacagagcaaaggtgggggataccccttataaaaccaaatctcgtgagaactcactcactatcatgagaatagcatggaagtaaacactcccatgattcaattacctcccactaggtccctcccatgacacatggggataatgggaagtacaattcaagatgagatttgggtggggacacagtcaaaccatatcagaagctttgcagatcattgtctctctctgttagacctatgattatctaattaaatttctattccaggctttgctgtacaaacaatactgtattcatttggcacaataaaaattaaaacagaaatatttgtcccggaaaatgtaaaggtatgaaatacctttcagaaaaaatgcatgtgtatttgtgtgcatgtctgactgcacacacatacacatacactcccaaaggagataatttagttggttttctttgttttctgattgccaaataaatttctctgctgaatacattgcaagtctaccctcatgattccagtttgtcatactgtgtttttatattccttccaattgaggatgttatgcctaaacatacaatgttccaaagagtctacttcacttcatactatattccccttagcaacattgaatccttaagacatccgttaaaagtcaggagcattcagttaacagcttaatagggttgggatctgtagaaatttatcaaacaaattaacattattgacttttaaacagacactgtagacagtttcaaagaatatcacgaggattttgtaaaagccacatcatactgtggatattaaatattcctggtggaataagatagctggcacagttaaaagaaactgagatattgcaaggccaggagcactgctctcctctgttgcccatgaatcttctaaggaaagaaaagtgctttcttgccacttcagagttgtttttggtttcctgaaactgtcataatttaattaaagcactcagtgtcctgcatatgtgacaccatctagttgacagaatcattccactcgatttttctaacaggggacaagatgcaggtgccaggcagctgctcatacagtatgagaatgggaggggcctctgtccaaaatgtctcctgtcagacgaattaaaatgattatgggctaaagctgggtgctaaaaatgtgtctgtgtgtacgtcacatgaggagggggctttaaccaaatggaaaacttaaacacacacacacacacacacacacacacacacacacacacatcccccaccccctaaaacccaagcaactttttgggactcctaagactgtaagtgagttatcgttactgatgggaatgggttctgtcccataggtgagtcagaacggagaaacggatgcctgtggcaaggcagtgttgtcagagacagaaagcacatccccttgtcggcctgtaaccacaaggtctggatgagctgaataaaaagaatagtagacacccctggtgagcgtccccgcagatgggctcagtccccctgaaggcctgtagcagggcagcgggagggccttctcaggctgagtgggacctttccataggcagacggtgctctgagcctcctgtatacagtagaatgggctcagcactgacctgtggcaactcatgtaatccccacaagtatctccatcttacagacaagaaagtgtgttcttaggaaagctaagcaacttgctgcaggtcacacagctagtaagcactagggtgtttccaaagcctaactgttcaatagcactcttactttctactcaactcaccccaagaacaggcacgaggactcaaggagagctggggatcacctggacacgaggatggaagttgaggtgggctcgccatcctttggggttggtcttcccaggagagaagagccgtggaatttacctggagatgctctgtcttgggcctcaccaatttcgaatttgttcatcataggctgccctccacattagtaggcttcaagcaggtcataagaactcaaaaaagtccaactaatcaacaaatgcgagtactttcccttttaaaatactttttcacaattgagagaaaggaagagaagagttaaggatctgctgagtgtggcatttcctcagaacttctgtatgtcttctccctagagcaagctgtgggcttcgcatagcatccctgttctcaccccaaagaacccgaggccaggacagtgatgttgaagcgggcagacggtgaggccgatgctccttcctcagggccgtaattaaaacgggagacttaggagctggcagaatccttgggaatcattttgtctgacctccttattggagataccatggccagtgatagttgataatttaccaaaccccaaattccttagtggtgaagtagaaaaaagagtagatttctggtttctaatccagatctctgttccttatgctgtaaataaggtgcaaacaaacaaaaaacatcaaccagaaaaatttaaaagccaaagagaaatcattttggaatatagtagaatcgcttctctacataactgactataatcaaagaacaggtagactcctgttcaaatgaatactgttagaacatctggtcttataaaatgagcctatttacatgtgctgacagatggcccacagtgaaaatgctttgctagtctgattacaacaaatcctaataaacccgaatcctctctcaggtgccttcctcagcccccattcatgtgagaggcaatctctattacaaggacatcggtgtgcaggcatttttcaataatttgccatacaactctatctgagcatcatcagacgcactacattgaaagaatcccggattttatgcaaagctatcttcattgggttttattttgctgctttttttcctggaggaggggcccggtggaaggaggttgacagctgcagaggcagtgactcagtgaaaagtggagagttccagagtcccaggtaggtgaagagcttgggggccgttgaattggtgggggattaatgatcaaggaaatctcagaactttaagtaactaacgcacttccctagacaatcctgaaagagctctaattaaaaataaagtaaatgtgtccaggcttttttgatatttcatcaaatttttgcaggaggggaagtgcttgtaagagcccaccaagggctgaatgtgaagacaggtgccccttcatccacacatgccccagggctgtgtcctcaaccctgacaccctgcaacctccttcagtcctctccatcctggtgcccccgaaacatgagtctcccatctcgagtctcccaggcactatgagcaggccgttgtgctgagggcagcacagagctagagacaaggccaccctgacaaggcactgtgctgggcatgtgatgtgctgggcacatgacagcactcactatgtcagcacaggacagcctaggggagccgcatgtccactgcccctgctctatccacagctctgtgcaggatgtgcatatttgtctcccagccctgatttgtgggcaggaggctcagagaaagggctggcaggggccagagggcaggagcagcgggcaaggctctccctgccacctctcgcaagggggctgtccattccggagacactgggccggacctctgtggatataatcccctgtctttcaggctgctgctgcagctgctggtgaacagtcatggcatgggggctgctgtgagtgaaagcagggagcgtggtccttaatgcacatgcgggagtgcccctttgatacagagttcccctgacttaactatttgcaacgaaagagccacttgctcctgtttcggaatgcccatgggaaggatggaaatgccaaagagcaaactcacaaagccactgtgggaggctgaggcaggatgatcgcttgaggcaggagttcaagaccagccagggaaacatagccagaccctgtctctatgtatatataaaaaaaatacaaagtcgagattaaacaggaggcccaacagaaatacaggcctgtggtccacacaggatgtttacaggctgtttcagagcttcagtccgacctacagaaaggcaggaggagggatgaccggccgcacgtcaacagctgtaagcacactggagaactgcctgagcgctcaggtctgttcatgttcattttagatgaagttttgcagaaaaagaacacctgttaccaaaagtgccacgccatcacataaaatgcctcatcagaatgtatcagccactgcagctctgagaggctgatggagcacgacctcataaaaggcttgaaatgaagcttaaagtaaatccctgttggtggaagaggtaagatgtttttataaaccgctaaatcatgctgaaattggaagtgtgtctgctgaggatctgaggtttttctaaggtattcatgcatgtaggaaatgcttctgagggtcccttcaccttggtgacaccatgcttctgcaccgccacttaaatgtactaggtgtgacttgggagtccattaacgcctggcaggcaaggaggttacatcatgggaatccatttcattaccataaataaatgtcatatggctgccatacattttattgattaaactgtcaagaacaaaattgtgtaagaacaaaaactttttattcctgtggcaaaaaaaaaaaggagggaaagaaaaagaaatgaaaatatctacataatttaatgtctctggccctctaacttcttacccagaataaaagaacaaagcccagcttactgctcccttggaggctgcagcacgacctgcctttcgtgtttctacagaacaaggtagccttttctcctctgcgttcccaggcctgttgtcaactctaaagaattgcttaaaagcacctcttcaggtagtagagcttatcttgagatgaaactaaaaaatagactcatttgccttttatccttaaaaaaaaaaaaaaaaacttacaggttggtaaaaagttaagttctttggattggccccaattctgtttaggatacagtttttctgcttcccttacttgagagcaaatagctgttgacctagaggcaaaatttgggcgtgctcccagaggggaggtggcccaatccaaggtgactgatcccaagtgtgactggggcaaaggtcttgatcccaggtttcctgtcaaaatagctagaggtagagttggctttccatacagtcttaaacttttttctcttgtgcttgcttttatttttctatccccttattgggccagggtattttttttcagtccaaggacaaacaatgcctcccaccatcacagataataattacaaaactttacctttgcacagagccttgcagtctgcagtgatattcacccctggtttttttttttcgagactgaatctctctcttttgcccaggctggagtgcagtggcacgatctcagctcactgcaacctccacctgctgggttgaagccattctcgtgcctcagcctcctgagtagctgggactacaggcacatgccaccatgccaggctaaatttttttgtgtttcagtagagatggggtttcaccatgttgcccagggtagtctcgaactcctcagctcaggcaatcttcctgcctcggcgtcccaaagtgctaggattacaggtgtgagccatcgtgtccggccacactgctgattttcttaaacaatcttgtccatctatgaaggcattatttatccctgatttacaaatgagacagaggctcagagaatgacttggcagaggtcaaatgccaggaagtcctacagctgggactagaaatccctagtaatatggtttgactatgtccccactcaaatctcatcttgaattgtagttcccataatccccatgtgttgtgggagggacccagtgggaggtaatttaaccatgggggcagttaccctcatgctgtttttgtaatagtgagtgagttctcacgagatctgatttttttttttttttttttttgagacagactctcactctttcagccaggctggagtgcagtggcacgatctcggcttactgcaacctccacctcccgggctcatgcaattctcctgcctcagcctcctgagaagctgggattacaggcgtgtgccaccatacctagctaatttctgtatttttagtacagacggggtttcaccatgttggctgcgctggtctcaaactcctgacctcaggtaatccacctgcctcagtctcccaaagtgctgggattacaggcgtgaaccactgtgcccagccgatctgacggtttttcccccttttgctcggcacttctccttgctgccgccatgtgaagaaggacatgtttgctttcccttccgccataagtgtaagtttcctgaggtctctccagccctgtggaactttgagtcaattaaagctctttcctttataaattagccagtctcaggtacaactttattagcagtgtgagaatggacaaatagacctagtctccaagtgcagagctccttctagactctgctgtggtcaaatgaccattggggatcagtccaatgaccatacaggatcgagtacgttcacatcttgaaaagcaattgttagcgcaacgtcggcacactctcttttctggcttcatctttccccatggagggtcaccaggtagcagaaacactcctggcctcgcctgtactcctcactccctcttccccaggaaaggaaaaaggagtgtttgaaatttgggagctaaacctggtggtaatgctcagccctggtcctcccacctcctcaaccctgtttgcctgcactgtacgctgcctggactgcacctccgggaaatatgtttgctagagacagcccagccccgatccagccccatggagagggaggcctcaggtgtctgccctgcacaggactagagtgagagccagcaccaaccctctgtgtatctttgccacattctccattattagtctttttagtcacagtcaactctgtctcagttggttcagaactcaggcaaggaggaggggctatttattggattccctcatcctgtaacacaaagcagttgatatttttgcacaaggcgcaatgcctaccaccccatcaaattctgctctgtgggggactgctgactgtgctactcagaataccatgaggctgcttctagtaaaattctttcccagatgactaggggctccagagagatttcattcaaaactgttggcaagtccccagggggcttgagtccttcaagaaccagagctcttttaacgtctcctggggactgcagtggtcttgtgcttaggctaaccagcactgtatgtattttattcttctttcacactttttgtttatttccaaccacttaatcctttttccattaaaattatgcaaaagcctcactttcctcattcatatgaaaatactttttcttctcttccacccccagttttctggttgtagttttactcctaaaatcagcaagacttgtttcacataatgaaagaagctattatacgtcttaaaaacttgcttttcattagcttctaaaacatatacagataaagtgaaaattccaaaactttatggagcattttagttttatgtggtctggaaggcactcactggggtagtcttggagcacatatgggcacctgggcagctgcttatgcttagctgtgtcgcacagacagatgtgattattagtgtcaattagtctcaactggtatgaaacaagagacaacgagatatggaatacaaaatattggcctacataataggttacctcttcagcttgagaataaaaagggagtatatcccactgggactctggcagcagtggtcgacatcctattttttgaccaggcttgagttgacagactcagccacggcctttaccaccgaggtttctttcaggaaaggaaagacaccaagtgaagggaaactattcaggctggtggcaccaacagcaacagccacatcctccccagaactaacacagaattgctgtattttacacagttttctcaggttagtgtgatcaactggagaaaaaaagctaacaattatatttctgagggatggaaataaagtttaaagggtgctgtgctgaataaattaactttataggaagggtacgtccagtgatctttcgaagccctgagctcagcaagaaggctggaaagccggctccctgcaggaatgaagccacctttgcgaaagtataactgagaaaattattatagtgaaagagatctgaccaaaccaactccatcttccttctcatctccaagctatcattgttcattcccgggcataggacaaactgactttgggagaaacttagttgataaaataactttgaaacaaagacggtaacagcccttttccaaaacaaacccccttcctgcctagggactagactgcttttgcaggacacaataaattagctacaaggttagaaatgatggtttaggagtcatgcagctggaggctgcaaaattctcaaccttctgaaattgctcctgggtataacatcattattgtaaaacctaaaatctgtgcttgagagattttgctgaccctgcattcaatggatcagttgggaccacccagatggataaagtggctcatctggtcagaaaatgactcagcacaagagggcagctttgatttcatttctccctatgatttcatttctgaccaaaccaatcagctccccacttttcaacttcttacctaccaaattatccttaaaagtcccatccccgagttttctgggagactgacagagtaataataaaactctggtctcccgtacagccagatctgtgtgaatgaaactctttctctattgcaattccccagccttgataaatcggctctgtctaggcaatgggcaaggagaacccattgggcagtataggatgaggaactcaaactcttcatctgatattttgcatcatattcagaatactttcacagccccaggcaaaaaggagtgtaacaaaggcaaagtgccctgtggcgcttaaagcttctgtgccatacaccatcctgatgggctgggtagtaccattcctgtaaattcccttgcagacaacattaaaaggcaggccacctaccaatgaaccaagctcattaccaaacatttcccaacaatgttgaagtttctgctagtgtaaagagtttacatacttcttttcccctccagtgtggggaagcaattctctaagaaagaagtttaatttatgaatgtctggctgccacaaaataataaggattttcccccactactgtagattaaattatcttatgaaatggattagaaagcaaagggtctgtcttatttaaaataataaaaagaaaaaatctttccaagctgatttgaaaatctacctagaagtcatttagctgtctgttccttttgttttagtatttccatctatcagggaattagttttgtccataaatgtaatcaatatggaatataaagtcatcaaattaaaaaatagatttagagttttcatgataaagtgtacctttaacttgagttaatacaaatgtaaattagatatagatatttgatgccttgcttattgcatttctttggtatgtgacagaaaaatgatcacagtgcttattttaattaaaaatttgttctctttctagaattattgtgatatttatggactgtaatagagaatttctgatgtatacaagaacacaatatcctctttcattctggaaatcaaaaggaagatcaaaggagtcttaactgagttactagtcaatcactttttaaaaaaagacaaaaaataaggtgtcaggtgtaacagagaggtctaagaagtcagtggaggtatacacatactaagtacccacaaaaattttaaaaactacaacaacaataacaacaacaaaaagtcagtggaggaattgggagaagttggaaaaaagaaaagccaaaataagaatttctggtgagaagagaggcagagccaaggatagaaggaactccttactatgatgtaaatgtggtgggttaatcagaaaattgatgcatgttttattatttctaaaaacatttaaacatacacttatatagcaatcttttaatggaagatcaaagcctgttttattttttaaagcatagatctacttcttggagtgtccagtcatcattcttttaaatcagtctttctagtttctggtttcaatttctttaaagtaaaactaggacataaggacagtaacaatgcaatctgaagtcagaattggtttcgagttttagattctttcatttttatagtaattctgcatgcaaatagctcaacaatagttttctaataagcctgctttattaaatctttgcaaatcactcaacttagttttttgtagaaacacttcttttttcattgatggtttcctggcttacttgatttttttaattaaattaagaaatccatattaagcacaactagtaaaaacaggtctgcaaaggaacacaactgacttgttaaaacacacaattaaaccggagggaggagaaatgctgaagctctctagtctcaaatatttagcatgctatggacatcactagggatgtatttcagaggaactgaaggatgttggttaacttgtgagcctcttctatatacattgctaggagaacattttttatgctactaaatttagataactcaaattcaatagtgtttactctcggaaaaataatatattctaaatggacatctttaaccaaaaagttaaattcatttaaacataggccagtgaacagatattaagaagtgtatattgcaatctactttatttaggtattccaaagatgtcatataactatctctcaatagctaagatgattcagttcttaaacctggctaacgcattagatagagagggacatcagtgtcatctcaaaaattatctgaatcttgagttttataccatctattctcattaatctctctcgacccactttttactactaaaacaagtaaaattttttttaaaaaaactttcatattaggcataataataacaacaatgacatttacaaaattacttccatggcataaagtactttctccagtattatttatttcattagcattgattgaatgtctgttatatgccagtttgacatgtgaattttttttagcctgtcttaagatatcttggtggggggggccacagttcatcaatgccagaggagcaagtaaaaaactattaacttcagtagctgcttcttgtgacaactggtagggtcccgcaggaaggagaatctttcctccaaggtggctcacctccaatctcagagggaaaaagcatagtctttttgagaggggttctaactcttggctgtgagcaatgagggatgcttggagtcagctaattaggaggcttaaaatttggaaaacccaaattccctgacccaaactaaccagactgttgggtgcaaagttagggattcactcaggttagggcatttatctacagattgatcatccataaaaatggtatctggatcaggctaggaaatgcatgtcagttttgaaagacatgactcatcttgctgttattgtatgtgagagagttgcatattagttaaggatagtctttgaaggtttataaatgggaagaaagtacatttggattctgtctgtcctccctggaagaggtggtagacacgtggatttcgcctgcctggcatgtcttccggcagctacatctttccctgcccttagttcgtttgattcaagtgggcttgtctcatctcccaggtccaagtgtgggcgcctgacctaggcactgccattcagatctctcatgtcttcatggcgtctgttggcttggacatatggttttggctaagccagggaaatatagatagggaactacctgtgctcatctctgctaccacctggggagagagtctatttgagagcagtaaacatggcatgagagccgagtgaagggaagacagacagcttcgagacgtcatttgaggacatgcacccaggcaggccaacagccaaggctgcccgaaatgactcagctgcacaaataattctcttttttgttaaagctaactttagttggattctattacaatggagatcatcctgactaataaaaccagactggaagcagaagtaggggtaagacctagaatctgtccttgccaacctgcatatcatttatccttatagccaacccaggagtgagtagaattggttagattttgtttctgtgacattttatcaataagaaaaaaaaattcaaagatgggaagccaatggtccaatattagatggttaatatttggcagagcagtgactaaaacccaagtattctgactctacttcctactataattgtgcaaaatatatgactgatgatgtttcaaaatcttacggaataatctcaggactaatttcctcaataaatagccaaaaaaaaaaaaaaatgaattacggaaacatactaaccgatatttggggatgtagatgcttaacttaaaccacagataccattcaacttgtcaaccatgatctgaaacgcacttgacaaaggtatgttcaggtaaactcatggaaatcagttggaattattggtctcatttaatcattgggataaatgataacattactgaatttccaaattcctgaaaatcactgtagtcattatagcaatcatttcaaaacattcaacttaaacgtttataaaatgaaaattcttactaaaattttttatagagcataatcctataaagcagtttgattgatttggttttattcccattcaactattttgcagtttcattcaatttatattatgttagatggatgttaatgtcctagctatatgtgcatttggcattgttgcctaattaaaacttcccttaatttatcaatgaaatcacaataaagtgtccatcactttgtattgcatggacacggggtttaagagcagaataatggcactgtgccctcttcaaagtcattatacagatgaaatcatgccaacatgtccagtagaaacagtcttgaaaagggaaataagttagaaaaggccgctgtctcagccatgccagcgcaggtggcggaggaggcggcgtatcagtgacagtggtgactgcgtgtgcatgcgtggcggaggaggtggcgtatcagtgacagtggtcactgcgtgtgcgtgcgtggcggaggaggtggcgtatcagtgacagtggtgactgcgtgtgcatgcgtggtggaggaggcggcgtatcagtgacagtggtgactgcgtgtgcgtgcgtggcggaggaggcggcgtatcagtgacagtggtcactgcgtgtgcgtgcgtggcggaggaggcggcgtatcagtgacagtggtgactgcgtgtgcgtgcgtggtggaggaggcggcgtatcagtgacagtggtgactgcgtgtgcgtgcgtggcggaggaggtggcgtatcagtgacagtggtgactgcgtgtgcgtgcgtggcggaggaggtggcgtatcagtgacagtggtgactgcgtgtgcgtgcgtggcggaggaggtggcgtatgagtgacagtggtgactgcgtgtgcgtgcgtggcggaggaggtggcgtatcagtgacagtggtcactgcgtgtgcgtgcgtggtggaggaggcggcgtattagtgacagtggtgactgcgtgtgcatgcgtggtggaggaggtggcgtatgagtgacagtggtgactgcgtgtgcgtgcgtggcggaggaggtggcgtgtcagtgagagtggtgactgcgtgtgcgtgcgtggcggaggaggtggtgtatcagtgacagtagtcactgcgttcatacgcgtggaggaggcgaaacgtcagtgacagggctcattgtatggatgggtggtgtttgatgcagcctcctaagccatggatgcatttacaaatagcccctattggttaagcacagtgggaccctgggagttgaatgccacaacccaaacaggattgggatcttgagtttaggatcttcagactcctttagttctggtcccctacaatttgtactgatggttccattgctgttctagaatcctgggcacttttaaaaaattcatactaaatttggcccctgtaggaaagaaagtacatttatctgtttcaaatttatttttgataaaacacttaatttcctattggctctgaactacaataagatcagtggcaatcaagtggaaatatgagacattgaatgttgatatttttctctctgaaggaaattgtgctcataatgtaatatggtgcaggggaaattgtattaatagtaacaggttgtggaaggtgtcctacacctgtccccaactagctgtgtaacccagagtgattcaccgaacccttccctgagacgtacatccttacctataaggatttccattcagagccttttcatatattgtttccaactgttatcttctgaacagtatgcagaacatacaaaataagagagggtctgatagggcatgacaggggcagagcaaaaactggttaatagcatctcgtcgacaggcgtggctctctgcccctgctcaccctgcagtggcttcttcagtcagggctaaggtctctgagcagccatcgtgcagagtgtgtgaagtcaataaatatttaaaaacagagcatagtaagcagagatgacaagtgcagccaccaccacagctcagtcaattaaatcctgctgccagcacaaacttcctgtgtttaaaagtgcaactgggtatgggcccatactcagagagtatattccttgtcaacatttttttttttcaatagaaatagtaagagttttcagatttgggctgtgctgatacaaacatgctcaaaatcccattgagaaaaacatattagtcatctaaatgaagaagtttgctaatgttctaaatctttctatcctgggatataattttgttttattgagtttcttcagtgttaagcatattgtgtcacagaagtgcttttagcattaggaaaagaatcatgttttaattttaatcctttcagataatttattaaaacaaaataagagcatgcaaagagcccagttaaagtgagcaataaaggcctagatattttcgtgcttctgagaaatttagtacggtatgagatttgctggaataaaatcaatagaattggttttatggctatagcattgctatttcatctctttgtttacttgggcatttattactggtgcatgatgcacagaatgggtagaaatgctgaaatgtggtcttttggctctcttccagccagggattattcaggtggagacaaaacaagcttgcttctccagtaaaagatctgatagccttgagatgcccaaggacagtggccagaagtaattgtagttttgccttattatttttttaaactcacacagatatggattgtacagaaatgcattttcatattctgaaagtgtaataaaagcctcaaagtcaacagctcagtagtatgtagacaaagctttgatccataagggaggtcttactgagtatatatcccttctgcccattatcccagtatataagccatcaatagatcgggggcaagggtgtgtgtccatcagagtttaatgaaacagtagggaggagaacaaacacctaggctcatgtttataggggccagggatagtctgtggactttcctgcaactgtccatggagccagccctatagttcttaattgccaatgtggattctcataaaattaaacagtattattctgtcttcactattaagagtagccatagtaaatcacctcctctccagttttctgttttaactgtgaggtgtagttcattctctggatagggatggcttctgtttgcctttgtaattcgttgcagaaaacctattatttgcatttcaagcttaggttcaggtgtctgcagtagatcaacagcataattctttgtactaaacttaagcattcaagcccagtctagaacacatttcacagaatgtcacagtgtcctagagccaaaaacacagccatagagtcaaccatgaacttggaaaatcctccagagtatgcagagctatcaagggcaacgtctcttaggaataaagcaattaattcagaaattaaattttctactttactctttctgcaagaccttagtcacatatatgactttcttcagggatccttaaaactatattagccatctgtgagtttgcaagtagctaaatacaccacctgtaattattagtttaattattataacatagtatcctcacaaagcattgctacatttgtcaaatgtgctgaaatcagttctaaccagagaaagtgttgaaaagacagtgagacaattcttctcaaaattggaggaacataaaagaggcccagctgactcacatcagtacatttgcatgactgaccccctctctcatatggtctccttatggtgagcgccgttcacaatgcaccctcctggcctcttgcttgccttagggctgagtgcacctgtgctgagaaccagggccattcaactcattattgtcatgatgcaacagtgaagaagtacttgaaacagtaaggatgcttctctggcttaaagaaaatattgagggattaatggtgttgattgcttctctgtttgcaacatgactgtatataaaataaaagaagtacgtgtttgattttacccaatggctgacaagcatttgggacatacttcttaagctgtttatataaaccaggttcagaatggtttagagacgtagttcatggacctatttcctatgaaaaggacataagagacttttgtgttttatttctcaccttctgaagtaatatatttcaaggcttttaatcagaaagaatgaattaaatgactaaaatgccagacccaaagtatggccaactgtatcttccaaagatggctgtcacatatttatcatttgaatgttcttctcacaatgtcaggttgacactccgccactgagtggtagggacaatgttgtctctccccaagctcaggcagaacactgtgagtgtctcaaccaacagggtacagtgacactatgtgactttgaaggctaaggtcataaacatgtcatgcacttccaccttgtttccttgacaggacccaacttggaagtcagccaccatgttgtgaggaagcccaagccacatggaagggtcgctgcaggtgtgccagcccagagtctcagctgaggcctcagaagacagccaacatctactgtgatgacgcccagatcataccagtccccagaggtcaagttatctcaacctacaggtcgttccagatgataacccagtaattttgcaacaaaggcaagccagctcctatgttctgcttatatgcctgacccacagagtccacgagcataatgcaatatttgtttatgtcagctgtggtatagttttttactaacttttctttatgagtttgtacagggagagagaattaagagactcagatgccagaccctaaagataaggtgctttgttacgataaggaattctctttccagacatttataatttaaggtatgttgatgtatttagtgcctaaatgtcttagcatggtatttccttgtgttttatacagtttgtctttctctactccccagcactacaacgaacatatgtacaaacttgtgtcaccagaaattgtaagtgacatctgcaaagagagagattgagagaaagagaaagagagagagagagaagacaaacagagacagggagagagaggcagagagaaatggagaccgagagagattgatttatcctgtaaacatccacatcactttacttaacctcttttggtactcggcctttcaattttgtaatacggccaatgaggaatttcggcaaatctcatatctaggagacctaggagcttgtgaagtccttgtccatcagtggctgtgcattcactggctcctggcatggtgtctggtcttgagtgtagacagtcagccttggagaatgtttactaaatgcacagtgaagggagcatgtgcatctcaccttcctggctaccttagttctcatgatatcctcagaggagctctttctaataatggttatttgtcatttccaagggtgtgctacattttgcatttatttaacatcctgaaattgttacataatacgtttattatattataatctcctttgtgtctctggtaatatgcacttttgttaaattttcatatgtatcattgctttatctaatagatcacatttaggacaagcaatggattaagactgccttatcagggaaatctaatgcttgtctttaagaagagaggtttagcttcaattaagacatatacatctaagatttatcactgcaagtagatacttaatgtctgtgtttggaatgtactaattaggttccaattagcagggtcaaaatatgtaaatcaaaagcacttcatcccctttggtgtctctttctctcccataactaattatctgtactcttcttggtcccagcaaacaccacggaccatgtctttaagtctctaatatggtttcttcaagtatgggccaggtgctgtcaacctgtatgttcctcctgaataagtccctgagggtgggagcagagggtctgcattttaccaagaagaccaagtaatctcactggaaaatatagcttgagaaatactattctttagccacttaggcattttcactatgatatctttagggtttatctgatggatacttaccaagtgtttctcatctctccaggggctgtgagtagcataagaaagcctaacccaccgccctatcctggaagtgtggtcaggttattaaggtattgcagatgacaatcatcatacagggcagctttttcagtgactcaaagaaaacccttagtattccataagctgatataccttttaaagttcatttctaaactaaacattgcaaaaagtttcttgtcaaaagagatttcagatgtctctatatactgtttcttgtataaatcacacacccttaccaagagccctgagctgggacccacaaatggaaatcaaaggtaatgtgttcctccattatataataggaatttcataaaacccatacaacagtcatctgtgttatacagaaaaacattcatcactgagcatttgaacattttgatgtttctgaagtacagaattcatgacactctgcaagtttttccaaccaatttacaaattattttcatccctcatcttattatcctacctagtgtcaacttgttctttcggcataatcaatctgaatgactggtaaggtttcatagtgcagcactttagtttatgcagacatctgcccaaaagcatctcaatcactcatagcaagaaacaggggcagcattagccatgaggaaatgctgttttgttacacatgtatatctaaagacagggctatttgtataaaagaaagtcagggtagtgatagacagaactaatgtatcaatgtcagcagaaaatgcaagtcaaggtatggcagcaaaaatcagcctcacagggtacctggaacaccattaatttaaatttaaagcccttgtggggaaacggatatgatataatcactaaattatcattcataaatgaaggtctatcaagtagactatagtattatatttatataagaaaatcttttcaccttgcattcacacataggggtttatgttgctttaagtatttttctagttttatcattacattcttaaactacagtccaatgtgtagcgataagggattactgacatttatagtaagttatttgttcttattattctaaaacaatagataattttgatatagaaattaagaaataacttatgtatgtagatataaagaagtaaaacatgatatatgattctaatggagaagataatgtgatactctctagctatttatgtgactttggaaattacttattgcatgctagaatacaaccaaaccagctattaaaagttaagaggaggtggcaaagcagaaaatactttaaaggaaacttccaaagagccccaggtgatgtaaagttataaaagctgaatttgcttttaataccaattcaacatagtttttcaaactgacgaaaagtacctagatggcattaaacccaaacataaaatctgtctgcaattaaccataaatccttcactatcccgtacacatcttgcttcatcggaatcaatgttgacttatcatgagcaatacctctgattctttagaagtatgtgctacataagatacaaattggctgggcgcggtggcttatgcctgtaatcccagcactttgggaggccgaggtgggtggatcacaaggtcaaagatcgagaccatcctggccaacatggtgaaaccccgtctctattaaaaatacaaaaaaaaatagctgggcgtggtggcgcatgcctgtagtcccagctactcagcaggctgaggcaggagaattgcttgaacccaggaggcggaggttgcagtgagccgagatcacgccactgcactccagcctggcaacagagtgagactgaatcttctcaaaaacaacaacaaaacaacaacaaagatgcaaatcaacagtgctgcatgaagaagtactcacccagaccctggctgggtactcatggcatgctccctcattgaaaaccgccatcatcagtattagcctctccacctcacacacatcataaaatgctcccagtaaatatcatccgggtgcgtgccatgaatttcatgtagttccctctaggaactttgttccactaactgcaacattctctctagccatttaggaataactagttcatacttcccactgtctgtcctccaccacagaatagagaagtacatcgtatatatactataaatacttcatttggtgattaaggtctgatgtatctgttgtatattgtgggtctttatagattttcttttgttaggagagcacatttaagggtaagattccaaagattggaaacattactggactgaagattctttgatgtaactgtgaagactcctaagaggaaaattctgcttgtaaactggccggccagccttcagggaaacatgtcacaggagcacgctggggtcacattgcctagcacaaaacagaactctattaaacatttgggatctgatagtctctaatgttatttagataactgaataaaatgcattttttttttaaagatggggatcttgccatgttgttgaggctggtctcgactcttggccacaagtgatcctctggcctcagcctcctgagtagctaggagcgcaggtgtgagccaccgcacttggctctaaaaggcatttttaaaaatgaaggtgaaaacaattaaaaaaaagtcgagtcaataaaaatttagccaattttcacatccagagaatcattttttataaacttaattatgttattttccttttgcatttggattggccctacctgaaaatgtatacatcatttggtttatgcttacccgtgtggctactgtgaaagatatcaaatcatgtaccccggaagcccttcatttattatggctccagggcaaaggggagcaaaggccacttccgggaggacgcactgatgacacagcaaagtctccagcagccatgaagaagcctggcccctgcaatgccgagagggaggaggatagaagacgatcaaggaagggccaggggcttggacccagatccctttcttggtctcctttctggtctgtcagtctggaaggtggcagtttcttagaaaacttctaacatctaaggtttaggaaatcccagggcagtggggcttttaaaaattgcttcggatgcagacaaagaaacctcaggcctactgtgtgcacctcccacgtgtgtatctacgtaggatgtagagaagacaaagggacacagtgagcatggtggtggcgaaaggtcacctgtctcccacggaggcatggcttcccatggagagaaggaggccagcaaaggccacaggggcataaccagcttaccacgccccctgggagggaccctttcagaagagacaagggtggatggcccactctaggagtgcagccttgcccagatcctggaagacagggtggtgtgactatggtgtgccactcagctccaaaggaacaagggtagaagctctggtctgagagctgacagggtgaggacagctgcagtcagagccagacgaggtgtcagcatgggcccagtccctcatcaccaccaaggtgcaccgtcacagaggcattcctgggcccacccaggctctcagcgtcattagcatgggcctggcccctcatcaccagcaaggtgcccagttacagaggcattcctgggcccacccaggctctcagcatcattagcatgggcctggcccctcatcaccagcaaggtgcccagttacagaggcattcctgggcccacccatgctctcagcgtcattagcatgggcctggcccctcatcaccaccaaggtgcactgtcacagaggcattcctgggcccacccaggctctcaccgtcattagcatgggcctggcccctcatcaccagcaaggtacccagttacagaggcgttcctgggcccacccaggctctcaccaccattggcacgggcctggcccctcatcaccaccaaggtgcactgtcacagaggcgttcctgggcccacccagcctctcacctccgtcagcacatggaagaagagaacagggaagagacccctctgcagacagtccactccatctggggctaagctttgccaaaccgagagagaaaggctttaaactgtgaacaatgtccacaataacgacaatactggaatcaactggatactgtcaaaaagagtctaggttttaaaccagaagtagctaaaaaatgattacactgattttactaggttggactaaatttagttctcctgctgctgagagaaattggcagcttgtcaaagaaaagttacagaaaataaaatgagttgacacatgttgattattgatttccagttcaaactcaccacacaggcatatcaacacacatgcacacacacacacacacatacacacacacacacacacacacacacacacacggtcatatgcataaatatttcagtcacattctttgattcacgtgtatggtataaatcagaaagcaactgagcatcttcctggctgcttccagaataaaccacgtttgttacagctttctagtctggggagacagccgaggtagcccgctgcctccaaaagctgactgtggcagctcgggtaactttggagcttgttttctccacttcagaatattaacttgcgggaagatgacattctgaaagaagacctgttctccaaaccattcggtcaaggagcgaaatcctcagcgatgggcgtgcagactgaaagtcagcgctcgggcccctgctgcatctttgagttgcttcaggagcctcccacctgactgctctgccatccatccgcgcctctcacacttctgttcctccccgtcttaggccccagtgttgcatgtccttggactgatgtcctgataggcttcactggctttgattttccacccgcctccagaacacagcattaggggttctgctaccagtcttcctaagctaaccccacaggacaggggcactctctgcagcaccccccactgctctgagctgttggagttgggaggaggcctgcagagaccttccagggactctgagatgccgtggaacatgcctactggttcctaaatccaatgaaacgtttcagtcctttaaccagcatctcaacgaggatgattccaaatctctgtctctagccccaacttttcatttgaattccagatcctgatgaggggcacagaggccttctctgaacttgatcaagtagctcccacccttggccccttggtcactctcaaccacagtgtcctaatttatcttctccaaaatactcaccagcatctaaaattatcttattgatttgttctcatgtttattgtatatccccctacctcttcccaaattcaccagacaggtgacgtgatattctaaggaaatcatataatactgctttagggtcaaataaaacacacgaatgtcaacgaagacggggactcgtaagttgtgtgtttctgaccctagaatggtacttggcgccaacagattctccaaaaaatatttggttactgactcaccaatctgtatcacagaagtcaacttgacacttccacctggacatctctcagacactaaaaattcagtccaaaattgagtgcacaacagttctttattatcattctgtctaatcataagccaagggcactactctctgttcagttccaaatccagacacccgagaatcaccttaactcttcgttctctttgacccccacatctcagcttgtcccagtgacctcacggctctggatcgcccatgccgccacttctcatgtagatttctgggacagtcttctctctggctggcttcctattaggcccttttagacataattagttttttaaaggcgaatatgaataagatgctcttttatttcaaatctcctcagtggcttgccactgctcctaggatcctgctccacatctctggaagagcattcaagaccctgtgtgagtggcctctccacccgcacccacaggctggcctttcctgatgctctagcttttcattagtaattttttaaaaatcctgcaaacacctgtcttattttcctaaggagatggaactcacttccaaaacattcaacgttgcaacaaccaaattgctaacagtccaccagtttaagggctgagaatatgaactctgcttctgtttcttgacacagcctcactcgacattaaaaataaattggttccccatctagatcaacttgaaacatgaattaaaaacgagtatactaggctgggcacggtggctcacacttgtaatcccagcactttgggaggccgtggtgggtgaatcactttaggccaggagttggagacgggcatggccaatatggtgaaaccttgtctctactaaaaatacaaaaaaaattagctggcatggtggcaggtgcccactcgggaggctgaggcaggagaatcgctggaacccgggaggaggaggttgcagtgagtgaagattgccccattgcactccagcctgatcaacagactgagactctgtctcaaaaaaaaaaaaaaaaaaagaaaagaaaagaaaaaaacggtgtgccagttgaaactactcacattttaaaaggatgtcacacaaatttcagccacattgtagagttttcttatttccatttaccttgcatgataagctccaccaacaaaaagcaacagaatttactatggcatgtatatattaaattgtatttttttttcagaaatgcaatttctttctgagattactttaatcaaaagaataattgcattattcatgagccatgctccgttaattggaagtgttggtcaattattacatgagatcgcatcacctttcaataaagagaaaagagttctcttgtgctggtctttcaaccacaattaccccctctcagtccagtgacttataacacagcagcaaagttaatcatttaaaactagaaatcatctttgaaaagtcaaccagtggaaacatgtttctaacaacaataacagcgggagagtgtactttagaggaattcataagtgcctctgcaacaggatctggataaaggtcatatttttaattactatgggtacaaattttacaaatcacatgctgtctttaccggtacaaaaaatttatcagaggtggagcttggggacatgcgaaataatagggctttgagtagttcctccaactttacaaatatttcatccttaagaagcagacatttaaaaaaattcactgaggaagggaatgcgatattctatgatactcacagcatactgtttagggatcaaatagaagaagtaaatattcaacagcaaggagctgttattacaatgggcttgatttttaaccccttatgttgtccaggtcctgcacattaaaagttctatgtgtgacaattcattgttttattcattaattctgtctgtctagaagattctgaacctgcttcagagggcatagaataagaaactgaggacgagaggaggcccagtgctgagtccctggaactcatgttgtgctgagcacagcgactaccatttagtacatgtttaactgccccataactgctggtctctccattgtccttgactgtgactgcctgacaaatctatgttctgtgcttcagctatgctgagcaccacattctcagttaggtatagaagatgtggtttatatagcacttcttacagtgcctctaagtcagtgacacttagtattccagggcattgagatgtaaatgtatcctgggcacatagagcatatacgctgtgtcacaattgttcaaaattaattatatataattcttttcttaatataggagtccagtggctacctctttgaggactcatttgagccttgcacagtgtagatgacactaaaaatgcatgatatgttgaatttcacacacatgtttaagcaggcctggtgatggtacagtggttgagactgtcctatttgtctatgttggcatgagattgaagcacagagctttctggaaggctagttcactgctgaggatacagagcagtgctaagtgtggggcagataaggccaggggctatgggctgggcataaggatggacagggcgggactctcactgggaaggggctatgggaaggtgcttggtgtcactcgagggactgggaggaaggctgacacaaaagcaggtgggcaacggccctggaggacatggtctccaggtcgggttttggagtcagacaggcctgaggtcagatctcggcttgtcgtcactggctgtgtgatcttggcaagttatgaatggtctttctaagcccctgggtatctgcagaaggaggcggtgactcaggactgcttactatccacacttattcaggttctacatgtggataatgagatgcttgatactgagtctggacagagatgtgttatctaaatcccattcattaccgagttcatacagtcagagttcaggtagggaggggtactggttataataactcttcttagagttgctgcaacaattaaatgagatgatgtatccgaatggcagcagctgggacttactaaggtctcaaaaagcattgtgactgctgttgctactactactactactacaactattactataatgattagaactattagtctgctatacaactatcacagataatattacttaattagaagggtagcggatggaggccatggctctgcttgaatgaagtggtttgaccttgattcacgtagtacgcattgctgagctgaagcaggagaatcacagaattatagcagtgctctgaaagcctggtatggctgcaggactcagatgagccagatggtcaaagtggaagagttggtaaatcaaggttattgcaataactcagttagtactaataagggccagggatgaatacggtagttacgaaacttgaaaggacaggcacaattctaaaaaccattcaaaggaaaaaacagggatggaataaaaactaaaaggtcatttctgtgaagatcaaagacacacagctgaagattcacaaggaaaaaatggtgagctggcaagagagatgatgagcatggcccattccttagaaaggagtctgattgtgaacaaaagaaaaaaccagacgtgaacagcggcagtggcctcacctctctgagctgccttcccatgtcctgggccgctctttcccctttgctgtctggtcctcctctcacaagtctggactctgttgctgcaggctcaggtttagaccctgcctttgctctgcgcacatgtccttcccgatctcatccattcttcttgcctttaaagaccacctatttgatgatgatggcacgtcctgactcagtttgaacatcccattggatgctgaatctcaaactattgatttttacccaaaacctgctcctcccactgccctccctatctcagtaagtggacacccagtcttccgtgactcaggccgagtcccacggtgccatctttcactctgctgcctgtctcatgccagtatctaacccacatacctctcgtatgtgcagagactggtggcttctcactgacctcagcacgcccactgctggtggaaacctccatcatctctgatctgggttagcacaagagacttctgtgtcatcatcttcactccagctacagaattctcccagcatggtagcccctaaagtaaggtctgactttctgcttagaactcttcaatcctttctcatcttatcctaaagaaaagtggagaccctcacggagtctgacagggccctctgaacacagggccctgctacttctctgcacccaccttgctcttctccacactcactgggccctggcaggttacatccactgctgtctactcaaccacacaggagccatctcagggcctgtgtgtctgcagctccatctgcctggaactcccctcccagatatctgtgtggctgcccatcccagttcctttggatctatcttcagatatcatgtaccacagaggccttccctgaccacctcctagaccgcaggaactcccttccccaccactacctgccccagcctctgtcacctgcttccattttttttttttctgtagcaagtgctgtctcatttctgtatatttgcttattaatttcttgtccattttcactaccaaagtacaggttctgtgaaggcagaggtgttgtactgtatacagccacatcatcaacatctagaacagtgcctgaaagatacgtattgaataaatgtgtggtacaagtacgctgggcacagtggctcccacgtgtaatcacagcactttgggaggccgacgtgggaggatcacctgaggtcaggagtttaagaccagcctggccaatatggtgaaaccccgtctctactaaaaatacaaaaattagccgggtgtggtggtgggcacctggaatcccagctactcgggaggctgaggcaggtgggtcatttgaactcaggaggcagaggttgcagtgagccaagattgcaccactgcactccagcctgggcaacagagcgagactctgtctcaaacaaacaaacaaaaaaaccatgtagtacaagtaaatacttaaaaaaaataagtatcccattctgtatggaaagatgaggaatgagctgcacagagggaaagttcgtaacgtgaatgttggctcaaaaaaaattcttcagtaagccatcaggggtggaataaaaagctttaaaaagtgcacgtagagggggttctaagaggaatgtgctattttgcgatgagatttagcctgactgcactctgcctgtgctgacctggatgcagacagtcgctgcctccaccgaggagggcgtgcatctcttcacccactcggctgaacttcagcagcttccacagtgacaggaacggatgggagaatggactttgttgtttcgagggatggtggtggtggtggtatttttatttgctcatttatcttggaagtatcgagtggtagacagtggcacatggcagtggcaggtgcagcagcctccagggagttaaatcctagccctgccactggacttctgactttggctaagggttgcctggtgaatggcagacagtggcacgtggcagtggcaagtgcagcagcttctggggagtgaaatcctagctctgccaccagacctccaactttagcaaagtctctgaccactttgtgtctttgtttccttctctgtaatatgagaatatgaatgtgggttcctaacctgtatctgaaacccaaggtttcagagcttttcagattttaggaaggtaatacagagtacaggctgtattttatggagcacccacagcagggtctaatcgaacacatgaggatatctgtggtgaaatacatgaacattcatacctagtgggataaatcgaggatattgatatggtttggatgtgtccccacccaaatttcatcttgaattgtagctcccataatccccacatgtcgtggaagaaatccggtaggaggtaagtgaatcataggggtgggtttttcccgtgctgttgtcatgataatgaataagtctcacaagagctgatggttttataaaggggagttcccctgaacatgctctctctcttgcctgccgccatggaagatgtgactttgctcctcctttgccttctgccaggaatgtgaggcttcccagtcacgtggaactgtgagtccattatgcctctttttctttataaattacccaatctcaggtatgtctttattagcagcatgagaatagactaatacatgtggcggtggcaagtgcagcagcctctggggagtgaaatcctagctctgacaccggaccttcgactttggcgaagtctctgaccactctgtgtctttgtttccttccctgtaatatgagaatatgaatgtgggttcctaactcgtatctgaaatctgaggttccagaacttttcagattttaggaaggtaatacagagtacaggccatattttatgtagacccacagcagggtctaatcgaacacatggatacaactgtggtgaaatatatgaatattcatacttagtgggataaatcaaggatataaacagcctcactgcagttcatgccaggatttgccaccaagagtgcatgtcaggcaagttttgtctccagatgagtcagaaatattagactttatctgtcaggttaatgtatttaacaacttggactttttattaaactgcaaaggatttcactttatgtatgattttaataacaatatttggcctaagttaaactctttccttctccctccattcttcccttgcctccttctttcctatgattctctaagctcccaacagccggccctgtggtgagagggtggctggtggaccacgaggagcagccgccgggagagaggctgggatgctgcacatgggggagtggcttgggttggctttggctccgcccctagctggccccagaatcaacagaaccctgaggtcaaaacagtgctcccgggagctccgctaatgcagcttctctctggggcccgcttccacactgatcttgcccctaaacccctttgatttatcaattctggccccatttctggtaagtcactccctgggaggcaagcttctccaatgcatggaagtcaggagcttatggaggagaagtgacctgggtcccttacatgccaggttatgtaaagcaaccccaaatatccagctgtgaggagtccgccagaaatgccaacagacgagcacttttcagggaaaaatagagacacagctccctctcacggtttaaatgtattgggtagagatgagcacagcaaaagaaatagagggtcttcctgttacgggaaaggggtgtacaaatggcacttaagtcaaggatgttcaatttgttctcactgtcaacatagggtaaagtggttctgttcagctttctaaatggccaggctattggctgagtacagcctatctgttcgagtaactgtcactttatttatagttacggcaacttcttagaaccggtatcctttaaaatacagcctaatactagagccagatgggaaaaaatcctagggtaaaatattaaattgtgactagtcatttaatagaacaaagttattcatgacagcttatatatgtcaaagcctatatgctggcttgtctataaactggcagatggatttttttccaaatactgagaagaatttcagtctggattttaaaacgagtaagttatttcaaaacaaaactgaccaataaaagaactgataaaaatttgtttaagcttattttattaaaaacaacaactgactttttctttttttttttttgagacagagtcttgctctgtcacccaggctggagtgtagtggtgcgatctcagctcactacaaactccagctcccaggttcaagcgattcttctgcctcagcctcccgagtagctgggattacaggtgtgcaccagcacacctggctaattttgtaattgtagtagagatggggtttcaccatattggccaggctggtctcgaactcctgacctcgtgatccacccatcttggcctcccaaagtgttgggattacaggcgtaagccaccacgcctggcccaacaactgactttaaaactcaaaaggctttatttaaattatactagtaaaaaaaccaatgaacattcttatttatcttctaaaccatgggaatatttaaataattttatattttattatttaatatagatttagtattatgttcctaaatctgggatatggctatttttttctgttgaaaaaccaaaaaaggccaactctatatgtggccagtatacaggtaactgaggctgacatagaagagagttacatgtatccaccaaacaaactcaacctatgaagatcttaaacattttttttctgttgattttcttgagttttcatgactattgcataatggtagatttatactatttccatgtggatgacaggagataatgtccaacatcttctacccctacaaatcagatctgaaatttctttatgatttcttaatactatcatcgagcattcaggtaggctccatgccggaaatttagactcttctttactgcttcttccttgctcccatcttctaataggtcacccaaccttgttcattctacatcaaaatctcctttggaagttggttcactcaccctacattagtatcaaacattttaggtcaaggtggcaattctgacttccagtagtgatttttaaactcaataatgacaacaataacaaaacacgtcatcggccttttcttcatattaagtcttatatgaacgcccattgtgtgaaacgctgaactgacagcctcccctttaccctctcagcagccccaaggcatcctcaccactgatgcggaatattagggccctctgtcttgtcttttccaacagcctggatgtctacccactccagcccatgcccagcatggacatcagagtctgctcctgcctcctggctcaggttcctgggggcagcgtgtggagctgagaagactgcatcgcctggattccatcccagctgggcggcttactagcccatcacacctgggcagtcccgtgagcctcttctatcctgtttcttcatcactaagatcgagaataaattacaatatctattttggggcatcctcagacaaacccactacagggcagggggtccccaacctcccgagccatggaccagtacctgtccgtagcctgttaggaaccaggccgcacagccagaggtgagtgggtgagcgagaattatcacccgagctccacctcttgtcagatcagtggtggcattaccttctcataggagcatgaaccttatcgtgaactacacatgcatgggatgtaagttgtgtgctccttatgaggatctaactaatgcctgatgatctgaggtggaacagtttcatctgcaaccactccactcaccctgtttgtggaaaaattttcttccacggaaactggtccctggtgccaaaaaggttagggaccactgccataggacctttggttcttccaacactcacacatagctgcccctcaccactacttattgattttaagtaagaaaaaagccagtgagtcattgcaacaaataaaaactacatgcaaggcaaatttactacaaaatgtctgactttcccagaaattatggttgctttttaaaacatattttattaaagaaaaggaaaaaataaaaacctctgcccctcactgtcctgaatgatataagactatctgattggatactagtataagtctgatgttgctgcctggaagaaagcagtgagaggcgtcagaacactccagcacactttggaatggccagggagttttgctggcagacactcagcagaagatgccttacactccctacctcaccagtccccacagtaggcggtggaccttcatgtaatgggagactcacaccttctgtgcaagagccaggcacatgggtaactccaggctttaccccatgctgcatttatgagaagaaataagacaatgaatgagcctgttaggccagtgtctgtcttctatgattaacacagccaaggaaagtctggcccacacagaaagagcagccctgcagaaacactagtccccctgagctttgtgcttcagcttttccaaacccaactcaatccaccatatagaaaactcagcaggagttttagccgtcatcattattaccctggatctcacaccactacaggataaactccacagttcctagcatgactacaaggccctccaccctgcagcccccaccttctgctagactttcttgctggtccattgctgacaggcagctgtgctctggcctcagggactccatccctggccccttcctagagcatcccctgatgcacatctgtggatcctgcaagcttcgcatggccaggcttatccccactctttccttctccagcccacaggtcaatctcctgcgatgctttctccaccccttcacgcagagtttattttcttctctaaactaccagaatcttttgttaatatccttgttagagggtttattgggtgctctcataattacagccaactataaactcctagaggtcaagagctggttttatcattcttcgtatctctagtatcttccctagtccctgatagatgctacataatcaataactatgtgttgaccaaatagatgattaagtcagcattatgttttaaattttatttaagttcacaaaaagacaacatattatgacacaaaactgttaatagttccttaaatccaggcagtgaaattacaggtaattcttattataatatttaaacttttcttcatttcctaaatttcataacacagcaataatcatagaaaataaaagagtgagaaaaacctgggagggtttatttatttaacatttcagataatcaaacaatgttaagtactaatattagtgttggcctctcctgctaaatattatgggaacttaccattgcttacatgaatgtatggattagtgcaataaaaattacattggaattctctagatcttgatgtatgttttcttaatttattctgacctaattcattagcttaagtggttcatacatttcacagctataagtcttgttcgctcatctgggaataaatctggtagtatatgctgacacttactaaaatgtaacaatatgattctatttttctgttagagacctttagcccagaaaaaactcccattaaaaaaaaaaagaagaaacaggtttttcatataaagaaaaaaaaaaaaaggcttcagtacaattggcatcttgaatgtcatggccaaaaactagagttccatgaaactgggtacagatctcattatgagcataaaaacaacacacgctcttaaatacaatgcaaaatttcctgctgattaaaaatacaaacaacaatgaacaaagcataatatgagtacaggaaaaacccatctatggattctatgctttagttatgtaacattttcacattagggcaggttctaatgttgatcaccatcatgaccagaaagagttgcaccaacatgaacaagaggtccctaagatattaagctccattaattcttctctgtgtaggcagttagggtcggacaagtacaggagggatggacttattataatgaggcctgggatggtttcttttataatagtctatattgtgcagaaaaaaatacattatacttacaaatatttggcacatagtagatggataatcaatattaactaattaacaatcctatggcgcaggaagatttttcataagcatgttgtggtgacagtgacttctcacatgaggccagctgtctatctcacccacatcctgtgacctgcttctaccccactggttctaccccactgaccttcttctaccccactgtgactaaggcactcctctccacatgctatatggtctgcatgtttgtgaccctccaaaattcatgttaaaacctaatttccattatggggatgttaagaagtgggcctttgggagatgattaggccacgagggtggagtgtggagccctcatcaatgggattagtgcccttatagaagaggcctgagagagctcatctgccactttcactatgggaagtcacagcaaaaagacacaatcctttacaaacaaggaagtgggccctcatcctacaccaaatctgccagcgtcttgatcttggacttcccagcaccttcccagcacccagaactgtgagaaatagatgttgttgtttgtaagatactgagtttattaagttttattatagcagcctgaagggaccaagacaccatcttcacagtgaccgcctccagctactttaatcatgggacagcttcctcctccccatccaatttgcacacaggggtcagccccagtcagtgcctcccctgcagccacagcaatgtttggctgggcttggaacaccacctgctaaaaaatgaccatcccttgggtttcactgtgaaatcttattaatgtcagcattgtatgtttccgatgttccaatgtaatggaagcaaaattcactaaggattgttcttcaagggtcagcatgcccaatatgtaacctgtcttaccacacagagagacaggttcatttacgtctctttaaaaatggttcttctgcttcaaccactagggattctcaactcccagaagaaagtgaaggactgatcatgcttttatctgctgcagtgttggtaacaacagctgactgtgggatgatcactgtttctacatgtggtgtgaggagcctccatctattaactcatatcatctggatgcagtgatgtcattagtcccgtttcaccatccaggtaactgaagtcacagagctggaaagcagcagcagtgggggtcacgtgagcccagcctgcagcgcacaggctctcagcccccagcatgctgcccctttgcagaacgggccctgagaaatgggaagcttttggttttcaagagtctctggatctcagtctggcatccagtgacataggaatgtgtgttagagatgactgaagatctgagagacataagcgatgtggcagaagtatttcacaattttgacctcataacttcttttctgttttgaagccctgggtgttggcaggtatagaacaatagagtggcttcaaagaagtgactctccgggtactatcctctgtgcgcttcccagagcccagctgtgttcaagccaggactttaggagaggaggtaggagataatgaagggacgtgattagctttgtgggacagccacaaactgggtggctagaaacaacagaaacgcatcctctcgcagttctggagcgggtgttggtggagctgcttccttctggaggctctgagggcaaatctgttccaccttctcttgtggtttcgggtggctgccaacaacccttggcattccttggtgtgtggactcatcattccgatctctgcctctgtatgcatgtgagtctcctctctgtgtctttgtgtcccttctcttcttataaaatacaccagtcaagctgggcgcagtggctcacgcctgtaatcccagcactttgggaggccgaggcgggtggatcatgaggtcaggagatcgagaccatcctggctaacatagtgaaaccccgtctctactaaaaaatacaaaaaattagccgggcgtggtggcgggtgcctgttgtcccagctactcgggaggctgaggcaggagaatggcatgaacccgggaggcagagcttgcagtgagctgaaataatgccactgcactccagcctagcaacagagcgagactctgtctcaaaaacaaacaaacaaacaaacaaaacccaccagtcacattgaattttgacccaccaaatccagtatgaccttatcttaccctgattacacctgcacagactctatttccaaataaaggcacattcatgggtgttggggattagcacttcaacattatctttttgggggacataattcgacccataacaggaaatgaagtgttttttcgtgtgttttcttcatgtttgtttttttccctcaagcactaaaaaataatgcaatttggctcctgacaacatgaatctaaaatctaattctgtgagcaggactctctgagcccgggcgcagatgggatacctgcatggggaggggcttgtgtcttgctctcagaaacataataaaccaagagattctgctgcattttcaacacatctctaagaataggcagcagtgcacctccttcttagtgttggcagtgaggctgacgtgacagtctgaatggtacatgcgtcccaggaacctcatgtcatggtaacagaggctacagcacctcacactgaaataagacgggctcagaccccccactgcaaccggctgcattgtcaccttctggggtacacatccgcggcatggagcttctttattctgttatcatccaggctatgagtcggagtattcaacattttaatgctccatatatcaataaattaagtgtgatgctggatggatgtgacattttcaatattccacagtatgactgacgggctaccgtagttcctcccctgtttgtaatttgagtaatctggatgggggacatgaactggccggccaataaaagtgaagactagtggaaagagcaaagtcataaagcaagcatggtccttcagagactgtattaaaagattatcgttttgtatatcattgttttttctttccagagcatgtaatcataaactgaaaagagaagagacaaaatgtaatgttgaccagaataaacaacgctgtgttcatcacttaatgttattacccagtcccttggttgtcttgtcctctgtttgttatcattttcgagggttttattctagacacattttttggtctcagtcagatttagtacagactaatataaagttctgctgctccacagtggtagccgacgcttctggaaactgcagtgaaatctcatgaactcgatagagttcactcttgcttggagcggtccacacacttcctttgtttaagcagcaatgatatgtcatgccaagctgagttcaactttcttggtaactcttgaagacaaatcaaccacactaataaattattcgacctgcaggttatatgagtaacaatggaccaccctaaactctaggcagcacagtctgatttccaacaaaagacaggagatgcagataacgtgtagatactaaatgtataaattgtattgtaattctgataggaaaataaaaccccaaaccctgaacaccattaattcaccatatgtcaacttaaaaaaatgtgaatgctagataataaaactttatgcccatgtaaatgtctaaacacaattttaataactataaataatgtagagatttatttcttattcattttaacaagcttttcactgaactatgatatggtattctaatattaatcttaaagatatcccagcatattctcaacttaaaatttaaaatatggctgggtgcagtggctcatgtctgtaatcccaacactttggcaggccaaagccagtggatcacctgaggtcaggagttcgagaccagcctggacaacatggtgaaaacccgtctctatgaaaaatacaaaaattagctgggtgtggtggcagatgtctgtaatcccagctatttgggaaggtgagacaggagaatcacttgaacccgggaggtggaggttgcagtaagccgagatcacaccactgcactccagcctgggtgacagagcaagactccattacacaaaacaaaacaaaacaaaaatttaaaatacgatgaaataaggcctttcctgtactaaactatgagcaatttatttcacaagaactcttgagtctctgacctattctagaatcatccaaaattgaaattattataaagtgttttctatgaatttcctacccaccaggcatcaaatgacagtatcaatggaacatgcacaaccgaaaaggatctcggccagcactgatgagatccttcataactataaagcaacaggactgatgaaccacacagtgaatccagccacataacttcataatcacccgtgcagaacacacttctggaatgctgtccactcggcccggcactcccctgaggactagggatagagagtgaatcgtagggagatggtctccaccctcacacacactcatccaagaaggcaagacagagcccaccatgcacaccgcaggagacaaacatggaaacccaagtcccatggggataagtgtgcggggtgggggctgggaatgcctggagaaggaggcaagtcctcagagaagaccactgatgataaagttgcttttcagcagagacctaaatgaagtcaggtgtgagccttctggaaactgggaaagggttccaggcagaaggaacaagggagcaagaccctgacgggaagcagattgaggtttgagagaaaggcttgaaaggatggcagtgactcagcaggggccagggcacattggccaggcacccattttaactactttggcttattccaagggagctgagaagccattggagtctgagcagagttgggacgttatttgacttcaattttaaaatgactgctctggcatctgtttggagaccaggctggaaggagaagcagcagagaagtggggaggtggaagatcagctgggggctgttgcagtaatccaggaaacagcccatggtggcttgggccacggtccaagccatggtcagattgtggaaggtgttttgaaggaattgtctgcaggatttgctgatgggtaggtagcatgtgtggtgtgagagcaagagaggagtcaagataacttggagatgatgcttgtgtccatttatggaggtgatgatgactgaagcaaaagaaggatcacacattcatatttggcattatgaagcaggagacaccattaggaactatggggaagtcagggtggcagctagaggtttaattttggggatcaagggtaaagttggagctaaagctatacattttggaattatcagcatatggtgagtatttaagtcaatgatgcaaggataagactacctacggagggaatacagactgggaaaaaagaaacaaagggggagaaggggtctaagactaagccccagggaatcacaacgtttagactgagttctgggctgggagttaaagaagaaccacaagatcatataatatcatgaagtatcctaagtatgaactgaaggcttatcagctgtcaacatagtagactggctgtcaaaggatggctttgctgtataattgttttatttttaatctagtatctcaaataaataaatttaaataaattgctctgtaaattttaaattaccacactcatctgcattatcattactgctcctatagtctctattaggttaaccacagttggtggctgttcaaggatttactccaataatgattatgtttcctttattttaaaatgcacatttttcccacattttaacatccctgaaatcacaatgtatcatacaattgacagcatcttagaactataattttttaaaaatttaaattttagattcaggaggtacacgtgcttgtttgtttcatggatattacatgcgtaattgtgggggttgggcttctaatgtacccatcaccctaacactgacatttatgatcagaactgatgctattttttccttcttagaggaatacacaaaaaagatacatcatataatctgtgacatctcagctctgatcaaataaaatatgtatttctaaagtcacagctctgttctattgtctttggttgatgtacaagtagaagagttggtctctgcacagctgccctctggggctagtgtctactgggatgatgaagagtcaagggtaggaaggaggcagcgccaaggagccccttgtgggcaagcctcttgacagtcaccgtattttgcccagggcttgctattgattagctctgggtgtcatacacctccagtgacttttgccttagcaagaagacagatacagttggaaacttacacaagggcttgctctggtttcattctccaggcattcttttcccctggagtcatacatccctgaagaatagaagccgtgtctctattaccttttaatccccagaactgagcacaatgcataaatatagctggtgctcaataaccattttatttaaattgaaacccaactccccagtatttggaaagacttgtggcctacaacctcagaggaaatgtacaacagattccctccctgggctgcggtagttgaagatcaccgactaactacggtcacataaggtatcatgtctgagtgcccagtactagatcctggtgtagtctccatggaaacatagagaggagcgcttgtatccttgcagagaaacaacaaatgcatcctttataatgataataaaatgcagcatttatagagaggataatcacctgtgttatgaaacaggcaatttaataactctgtctgataaaaacgcaaagacaactgtgatgctgtattttacttctgggggtgtcggcatctgagttcacgggcagtggtgtgagcagcaagaatgaatcttcttcatctccttgtcaacctgttatatgctctcttgctgcttactatgccgttttgtctttttctcctcattatattccccagctcatacatcctaacctactattccacttatttcttcctttacatcatgacctgtagtctatattcctcacaagaaggtcctcaaggaattacaaaggacttttagaaataaagacataaaatattttttacagttcctgcggaaggctttttgtgaagattgtgctttacatgtattaaaaacacctctgagagtagccataaaagtaaatttgaaaatgcatttgaaatgtaaatagtgtttgcagcactcaggtgaggctgcttcaggtcacatgtagcaagagctctgcttaagtcttgagttatcttttccttccagtttcctgaattatgtgacctctgagaggcactctgagtcctaaatgggtagtactcggcagtgactacgattcctaaacaattcctgtcctctctttcactccaggatcttccaagcctgcagcccctggctgcactctggtgccactagaaactgtgggccatgaaggagagatgctggcctgggttcgtacttggccacccaagagaagtaggatgtagtgctatctaacaatgtctctccaacaaggagttcttgagtctcttttaatcagggacccactacattaatttgcataatctgatctggagttcaatagatcaatgattcaaggtaaagaaagctcctgcagcagttcctagcccagccatttcctagccagctaaaatgccttggagctcaggtcagcaaactggctctgatctaagaatggtttttactttttcaaatggttgggaaaaaatttcaaagaatactatttcatgatgacagaaaataatataaaattcaaatgtcagtgtctgtaagtaaagtctgattggaactcagcagcctcactcattcgttcatggactgtctagggctccttttgtgctgcgacagcgtggttgagtagctgggacagagaccctatggcctgcaaaatccaaaatacataatattatctggctctctgcaggaaaagcctgcagacccttgccttagattggcaggcctagtcaaaggctggcctgttttggggactttccagcaatctggtttcatgtagggtgctgctgtgagacatgctgattgaattctgaaggacagggtgagacacaagcagggaataacattctgagaaaaaaagttggctctgtcagactacagggatgagaaaaaaacagctccttggtggtgtaattagtagtttaagtagctttgtctgcaatgatgctagagtaatctgcggtctttcatcatgttcaaggagaatgcacaaaaccactcagctcactataattgcaaatagcccttaatgaatatatatttgctttggctcctctgctctattttacatcaattcttgtgattttccaagtcataaaatgccccagatgcctttcactaaggcattttcacctggataaaaagatgtaaacagattagaccatttctaggtgagttatccaggaaacaggggtgatacaagtggattatctattttccgatctggaaaagtaggagtgatatagaagagaatcaatagttctctacaatgaaatcttagccttggagaagtgtttggtgaggggggtgaagatgggggaagtggcattgcgagagatgcagttactcactgatgccttgcatggtatcacatgatgtcacatgacactgtatgatatcacaaatagaaatgcggactctgatgagctagaactgagtgtcggcttctccgttgccatgcagcccaaggtaaaccactgactgctgcaagccttggtttccttgtctgtgaagtggtagcacgaagccagcactgctgtgacctcccaatgaggtagacggagcaagggtgccttctatgctggcagctggtgctcacctcggcagcacacacactgcactggtggatgggaacttctatgactgacgccaaatagcacactgaaatttgaacacagtgtttatgatcctgaggttgaaattttaaaaaatttctcaatggcaagcatcaacctcaggacactaagtggagaaagtgagatgttattaccaaatctcaagcttgactaacattaaggtgcttgacttgaatcagtgtttctaaaagaaaatgaaaacttctccttcactgtgactcacaaataaccagtaaacaagaataatatgttatagaggtgaaaccagctactcatggactcaaattttcagttgtactgaagtgaactgggcaaaaaatcttttaagaactgcctccaggagtgttggctattttgtaaatagtcaaggatgatggttttcagactgtctagataaccttaacctcaccatgaaatgcaaattatttgctttaaatggcaaaaagtagaaaagctctattttgaatggtattttgtttttaaaatactcttactctttaaagtaagagtcaagaaataaaagacatttatttgggcttagaacacaatttatctgagattttatggtaataacaatactgaatcacttttttttttttttttttttttttttttttttggtgaaccacaggcccataagatcctggctctaattctggctttaccattcctagctgtatgagaattggaaaattccttaatttctctgaggctcttcattttcttctatacaatggggacaagtgtaataatggtattaacaaagtggatgtaaacatgaaataagataataagtgtaaagctcttaccacaaattaagagcataaaaagttatcagaaatggtcatgtatccttggttataaatacaggtcatatatcaattctggcatttatttaagcaaaaaacctttaaattccactcttattttggtgcctgatttttttttttttttttttttgagacagagtcttgctctctcacccagactggagtgcagcagcacaatctcagctcactgcacctcccgggttcaagcaattctcctgcctcaacctcccgagtagctggggttacaggtgtgcaccaccatgcctggctaatttttttgtatttttaatagagatggggtttcaccacattgcccaggctagtcttgaactcctgagctcaggcaatccacgcaccttggcctcccaaagtgcggagattacaggcatgagccgctgtgcccagcctaggtgcctgattttatttttaaaaattaattttcaggcatggcaacaaataaagaaaaaacacacccatttcacgatgcttattggtgacccccaggagaagtgaattgagctatttgagggaaggacagacacacacacgcacatgcatgtgtgtgcaggtgcacatgtctctaaacatagtataaatagattatgccaaccagcacagctccagatgagagtgtctgatgccacagcggcacatcatgagcagtcacccttcactcaacttctagcttgaatagaggacagagatttcaggagcatcgccaagtgatgggtttgggcctggcagatgtgattctgagtagctactgcagcttcggtgcctataggactaatactgcagagatacagtgttttatctttcaaagccagtacattccagggaggctgtatcctggggctgctaaagacgcctgcaagactggcctggaagaaatcctgggagggtctgcttcaggccactgagctaggctggaaacacctgggacagcgcgcctctgacccctgagccacactcgggaggaaccccacactctggcaacaaggactgggaatgtcctagttaggcctccctccctccaccacagcctcggaaggtacttcccgcttgggctctttcttggcaagctggagtttcaagtctttttttttttttttttttttttaaacaccaacctagacatctctagacagtacaaaagtactggaaaatggggaagcaagttttaataataggtacctttggtttataatagaaccaccccccccccttttttttttttaagaaacaggatttaaagaaaaaatgttttcagttcagagccagctttttttttttttttttttttttttttttttgagatggagtctcactctgtcacccaggctggagtgcagtggcacgatctcagctcactgcaagctccgcctcctgggttaacaccattctcctgcctcagcccccccaggagctgggactacaggcgcctgccaccagcctggctaccttttttttatttttagtagagacggggtttcaccgtgttagccaggatggtctcgatctcctgacctcatgatctgcccgcctcagcgtcccaaagtgctgggattacaggcatgagccaccgtgccctggccagagccagccatttttaagtgggacaattccagtacaattggccttgttgctgggcaaagacactaggattcattgtgctattctaaataaacttttcgatcaagagatggaaatgcacaacacatcataaaggatgtgaaggaacatttccccctttctccttaattagagcacttggtatttgtgatgaattaggctgactcggtaacctacaggacataaatctgcagaacaattctattttccaattgctagctaggttaacacgccttaataaacaaataaatatctccatatggactattatccaaagcaattgtgaatccttgcagtacggggcagcgtgtggtggtgacatcctgtgaatggccgagttctgaggccgtcctcgagcgtccatttgagtagtggcctaaatgaggggtgcccttcacggatggaataaggtaacattttgattaatgcaatgagcatgctgctgaatgttacagtcagtattaaaatggcatgtgctaatttaaaatcttagttgtcattagattagagtgcaaaggagagccaccttttgagaagacttacttcatctcagggggcagaaacaagcctgtctctgtttgccactgcaggtgtctggccaacaatgcttgggctctgaaaacatcctgaaatacatatatatatatatatatatatatatatatatatatatatatatatatatttttttttttttttcttttcctaaaacaacatggaaaggtactaagcagcttacttgtggaaatgtataaaactaaatcaaagactttaatacaactgcaaaaagtcacaaagtggaaaaagggcagaattgaaaagcaatgtgattcatgtctggtaataggtttttgagtttttaaaattttttaaattttttattttttgagacagagtcttgctctgttgcccaggctagagtgcagtggcacagtctctgctcactgtaacctctaccgcctgggctcaagtgattctcctgcctcagcctccccagtagctggaattacaggcacctgccaccacgcccagtgaatttttgtattttgagtagagacagggtttttgccatgttggccaggctgatcttgaactcctgacctcaactgacctgcccacctgtgcctcccaaagtgctgggattacaggcctaagcgactgcacccagccttgttaataggtttttaaagatgggtatgcttttgtggccaaaatgcaaaagacgtatttttgtcagcaactaaatattatttggaatttcttctcatgatctctagaaaatacttgatcaggaaaaataacttaagttatcatttttacctttttccaattgcaactctttttaaagagtccaagtaaatcttttttttttttctcctgattgtctttggaagtattgatccagaaatacttcatttcaatggttacaagtaacaataaatttaaaatagcatctgatttcctacaatgctcatttctgtatttatttgaaaatgagacttgcagggagccattatccacactgtgctttgacgccaggtggcttcgctcctggttctgatgggcagctcaagtggcgctggagcttttgctggccacacactcactggaggaccctgtgtcagacagtgcatggccgatgacacagctgtggtcaggacctgccgctgccctttggagctcacagtcccaaggggtaggcagatatgtgtggccagataatgtactaagtcacactgtgttcacctgaagttctcgttcttcatgccaaagggcatagagccctttgtacctgtgcagaggacgtctgcaatgccaagagcaaagggctcctgcagatagaccagggaccgcctcctgggttctgtgaaagccgcagttccccaagtctcctggactcctgagaggaaagagagagtcagggacgagtggctgtgaggagaagagagaggacagggtaaagacggcagataccaaaagaggaagaaaggaccagcgctctgcacgcactgggctcagctccctggaagcccccatgggaggtggccaggtgtccacagggagggctgcccaatgggccccacgaggcagctccactgggcatggcagcagtggagcaaccacttgggaacacacaggtgtggaaaagggcaacatccagagatttttcggattccatagaggcctccctgaggcttgggtgatgccggggaggaaaagagagccgggaatgctgagatggaatttgctggtcagccaagagtcagatttaatttgattttaagaaactaaagaagtatggcatttcttgcacatttaagtttgtggtttaaattttgaactcaccaaaacatgtacagaaatggttagggtgcattgtgaggactgaggaacaagactaccctgggcagaggcaggagtgagatcggagctggggaaaggcctcctgtggaggggctgcggggagcaggctcttgagggtagagtgcaagggggttgggtggagaaagatggggggcattctcaggcactgcgttcaggagaagggccctggaggtgaaacaaacagcttctcttttgtcttctgtggtttctcagcctttcattcggaaacacttggcaacatgggagggagcagagggccgctctgcaagacgcgaggcctggtgggaagccaggcgagaggagcagaacatggccacagcatgaagaaccatccctgcaccacacagtagagggtgagcagatgcctggatgcaccccaatcccccagcaaagccctgagctgctttgagcctcagttacctcggtggcccaatggagactgcactgtctcccggcaaggctgctgggcagctcacggaaaggacaactgtaagatacaggtgttttctgcctggcggtggtgagggctcctcacatttttcttttatcctaaaagcaacaaggagcagcagcagtttttagggaggagcatgcatggcacgacctacgtgccctttactcatctggcaagggcccaagctgagtgaaatctgacatcgtagtagagcaggtcctttgggcctatgaggaggcagaagggaaggaagaaggacggcttccctggtgttgactcagcaataaagctttcacctgcagagaagggtcgggatgctgacagcagcccactgattgcaactcagtctctcttgttccagtttcccagacgcgtctgggtcctgggaaaagaggactggagtgtcaaaatggggaagaatcatttcattctaatctgcactcgatcttagccaaaagtctgagaagcaatttccattctaattgtaaaacaagtggcaagagctaggcatctctgggactcctttaacagaagacgaacaaaggggaagaccattgcctctttctctcaatccctttcctctcccctcagctcagagctccaggtggctccagcagctctgacatcacctgcacccatagcgcttgacagggcagcacctgaacgcttgtaagtcagacctgacaggagcacctgtgctgcttggcagggtggtgtggggcgaactggagtgaatctgtccttgggtacatggaaaacatactctaaggactcctgaaattgaagaaggcttactgctgtgaccatggccatattgatagctgtaggcaggctgttggggtgtggtgagacgggcattataagacagggatagcagtggcacagaaggattgatgtggacaaagagccacagcaaaaacaccagcgagaagacagctgccatgatttaaatgagagaatatagggctctgaaatttaaaaactgacaaaggtgacacaaattcttcacttaaatttcatatccctgaattatctgcataaaacaaagggtaaaagggagaaggtggattttaatcttagcatggaaacacccacatttaaatgtaaagatgtgaatatattctaagtattttaaaaagatatattcaaaataattaaaatgtttctcattttaaagaaataagatgtcagatgaaagatgttggacagttattcttgaaagtggtctaagattgtttacaaatcatgtctgcttggagaaaacatttttcaaaaaaatttatttaaaaaaaattttcattttaaggctgttaaaaaaatttatttattattacaacttttttttgtagagatgagggtcttaccatgttgcccaggctggtctcaagcaatcctcccaccttggcctctcaaagtgctgggattacacgtgtgagttacccaccgtgcccaatctcaaaaaaatatttaataagaggaaaatccatgtattggctcctatcaatcactgcccactattcagcctttctccccaattgactaagaaatttatgtcacatgatagaagtgaagaaaaattaagtatattcacgttatatctaaagctttgtataatatctaattattccaacaccaataaaatctgttatcacctattagagggaaaaaatgtccactatttagaaaatgtatagagaaatgacctggaaataatgaccattctaaagacacatgtaaatatctatagttttaaagcatattttaaaatgagataatttaacaaataagagttacaatgataaaacaacaattatttcactaaagtctatattttaggtcatagaaagtgcttttttaaaaggaaaaaaaaaaaaacattcctgtgcagcattttacagatttcaaagcatcattaaacaactgagaagtgaatttcttttcagaacaggagaggccatgcatctcttacaccacatctccatctatttcatcagcagttgtgttaaaattcctagatgagggatcagaaagctttggaacttgaaatcagtttgtcctcaagactggtggttaacatgatatcattgactattggaaacaactgaaaaactcttttttttcctattagaacatcgaatacttctacagaatatttctattctatgttctaatgtaaaaatattcattttttaaattttttaattcttttaaggctttaaattttgacaggtttgccagtactcttgctcggcagttttttctacttcatctgttagtctgccctcctccctgtctggaatgatctgcatagaaaggattgtgcaaattctcatcggccacaaacgttctgctcacatgtaccagatgaccctagtgccttgcaagaaacttgagacccatcgcatgatttctccagaatcagatccaacaggatgcactgctcctgctgaacaactaagaaacgttattttcaaccccagcttgaaaacttgatagatagtgttttcttattagtaatgacccactggctaagcccttttcagacatctaacaggtcatgagtatgtgattatcatgctcaaatttacacatatgaggggccctagtatggtttctctctttctatatagtgcaaaaacctaacgattaaatattgatttaaaagagtgtttggagctcagccagtaattgtgcagcccggttcctaacaggtcacagccaagtacgagcctgaggctcaggggctggggacccctgatgtataccactggcgagggactctaataatgggaaagactacacatgtatgatggatatgagggcaaagggtatatggggtatctctgtaccttcctctcaactttgctgtgaacccaaaactgctgtaacaaattaaggtcttaaaatacatatattacttctcttcatcactgaggtttctgatacccccttaaattttgtactccaggccaatgcctcagcaacctcaccccggtcccaggcctgtggctcatcatatgtttccaaatcaccgatgggttttgcttctagtgacttatgtaaatataagcattattttacaatgtttttaaatttaatgacaaaaatactgcacactcataaaaagtaaaaagtagaaaacagcaaaaaaaaaaaaaaaaaagagtgggtaaattgttgactggtcatgattttgtagaaaatagtaaatttgagagcataagaagtttgagatcagctttgaagttcctgagttcaggtcattagcatttaattatcaatgccacctttcagccatggttctccatttttataagtggatgcctagagcacttggtgggatttcagcaatactttcatagctctccaggtgatgtcaatggctagggtaaatggtgtgggtggcatgatacagaacatctgactttcccctcattcttcccatatgtttacatcctacttatctacatagatcaaccaataaaccctttgcgtaaaaattacatacacactataatgctcttataaatcttcacactttgttgacacttagtaaatattaaaaaccataaatcacagaaaaaatattattaagttttgttattatgggtccaatctacccagtggcttaccatgatctacggaataaatttcatactccttagatttgaattaaacatccccagagtctgttgccaagattttccagcttctttcaaactacttcctatccatacacagggctccagtgagttaggaattatattctccgagaggaccctggaatgtctgccttcgtatctttgctagttttgttcctttgacttcaaacacacttagcccagactccctattcaaagcaaaccacagccatctccttaggaaactttctccattccccacaagggcgtgcctccatggccccacactgcacacatccctacagtaccaggaaccacgcctgaccttggagctggagttgtttgttactggctagtttcctccaggacaaagtaaactcactgaagacagagaaggtttcttatagcttcttccttgctgtgcactttatagagaatgaaaaagtgttccattgaatggaatagaatcaagaagtcatgtttgggtagtagaaatggaatggacaatcctcttttttaaagaatacaacactggccagtcacggtggctcatgcctgtaatcccagcactttgggaggccaaggcgggcagactgcctgaggtcaggagttcgagactagtctggccaacatggtgaaactctgtctctactaaaaatacaaaaaaattggccaggcttggtggcatgtgcctgtaatcccagctactcgggaggctgagacaggggaattgcttgaaccagggaggtggaggttgcagtgagccgagatcgcaccactgcattccagcctgggagacagagagagactccatctcaaaaaaaaaaaaaaaaaaaaaaaaaaagaatacaacattaacaaaataagatatatctttttttttaaattaaaaaaaaatgtatgttttgagatagagtctctgtcacccaggctggagtgcagtggcaccatctcggctcactgcaacctctgcctcctgggttcaagcaatttttctgcctcagcttcctgagtagctgggactgcaggcgcgaaccaccacgcccggctaatttttgtatttttaatagagacggggtgtcaccatattggccaggctggtctcgaactgctagacctgatgatccgcctgcctcagcctctcaaagtgctgggattacaggtttgagccaccgcgccgggccaagatatatctattaaaaatatattaaacatgttttcctgtctttagagtcatatcctgttgtgtctgtcctttcaaatggaaaccttgacacagctgcagtacactctgctttaattacttacttaatttgaagaatgttaaaggtaaaattgtaataagaaattgtttcccaacatactttccttaggttccctgctacctctttagttttgtttttttcttttcattccatatctccaatccacacagaatgaattttatttccttccctcgtcagtctttcaacctcccccgcaattctcaaccctgcaattcaacactctgctcccaaaccagccttcttgtcacttccaactcatcttcttatttaagctgcattgcttttccgtgaattagactggatcttaagtgaaggagacacaaaccaactgcaaatgatgaataaataccatcagtggggacttagtgaatggctaggtcattttcacccccagtgccaggaccatcatgggaaagtcgtccttttggctgttccggaagaagtggcagcatagtgactttctcctttccctgtggatagcatgcaacaggaccaaagggagtattctgggctcccaaaacatggggaagagcctatgctctcatgtttggacattcctagcaacgggttccattaaaaagctgtcctaaactctaggcttatcaagacttttacataaaaagactattgcatttttaaaacataaatttcattcctttatgaacttcaaatttgctgctactaaaaacatgattgctcttgtttccatgggacttttcttctagtgagtctttgtggaatgcctgtgatggccaggtactagtatagcggcgcaaatacaacagcaactagtcagacacacctacactcaaggaatttacatttgtgttagtgaaacaggcaataaagaagggaatgacaagcccacctttttgctcttgttcaccactcagtgaaggtccatgggctgaggtgggctgtgggtctctttgtctggtgcaccttgttctgaagcaagggcatcccaacagacaacagctgcccttgtgtggcccaaggctcaatattgtccttgacgtggacatggaaggaaacacagaaatttcaacctctgcttccgagaaatgattgccaattcattcagaggttagtctgcagagctgactgagatcaccaagggaaactggaagcttattgccttccaactttatttctttgagtgcaaagcctatgaagataatctgttctcagtcaaagagaaatttaatatagcactccctgatttcttctatttaattcatagtctcctggcaatccctaaagtacattcactgtgtgttcaagttttgccttgttgtttgcttgcatcaaagagagaattaaattgtacacacacacacacacacacacacacacacacacacacacacacacacaaagtgaacccagatcccggttccctcaaggctggcctaaaagttattgttttcatatcaggtttaatcaacagcttctgtcatattccatatgccacctcgttctattgctaacacttttattttctaatgattaaccttaacacacacaattttgccttagcttagccattttagttatataatcattctgaaggaaaaggtcaaatttatgaatttctagactgttcagcaccctgtagggactgtcaaaaccttttaaaataaaagtgattattttccatgccaagaaatcgctgggtcattgggaacagtgggcgcatcttgcttcccatgccagcatgccctgagtgtccctggccaatgcatttctaggggtttccatgctagatgtcctctttagacataaacagttttcacgcccagcttaatcatttatccgagggttctttaaaatgtgaaagtcattctataaagaaaaatttttttttttgagacaagagttttgctgtttttgcccaggctggagtacagtggcgcgatcttggctcactgcaacctctgcctcccaggttcaagtgattctcctacctcaactgcccaagtagctgggattacatacaggtgccaccacacctggctaattttgtatttttagtagagatgggatttcaccatgttggccaggctggtctcgagctcctgacctcaagggatacacgcccgcctcggcctcccaaagtgctgggattacagacatgacacaccgcagctggccagaattttaaaatttaatttagaattaaatgattaagaaaaataaattttgcagctgaagatggaaattccatgctctaacttccccatgccaccagtgattacactgtaaggtggatcctaaaacatgaggtcattatagggagacaccactctgtgccttggtgtgagtcccccactctctctaccagactttttactgtcttgtctttgcctttccattcagtcagggctgtcctggcaatggaaggcactgctgcgcaccctccttacactctggccattgagagtttggtgtgtaaaggacagcagggatttacaatcccacagacacagagtttgaattggaactttcctctaatgtcagcaggctgagctccattatggacacatcccagagtccttacaagaggaagaatctggaagatgctggaatggcttggacttaaagagccttctaacctgactcactgttaacttcctgtgatggttaattttatacatccacttgacaaaatcatgggatgcccagatatctggctaaacattatttctggttgtgtccgtgagggtgtttctggattagcatttgagttgagaaaagcagatggcctccccagaatggatgggcagcatcccatcactaaggacccgaacagaacaaaaaggcagaggaactctgaattttccctccgcctgacctcttgagctgggacatcaatcctctcctgccctcagcactcctagttcttaggcctcagactctgactggaatgcacaccattggctctccagctcccaggccttcaaacggcatcagcagctttcgtatgactccagcttgcagatggcagattgtgggacttttcagcctccataaacgcaagaaccaatttctcataataaatttctattaatctatctatctgtgtatcgatcgattgaacaatccatccatccatccatccatccatccatccatccatccatccatccaaccatccgtccatccatccgtcctcctttcctttccatccatccatccatccatccatccatccatccacccacccctatcctattcctatctatccatctatccacctattcctcaatccatctatctttcctattggttctgtttctccagagagccttaacatactgctttagaaacctccatctcttccacatactgcagtctaccagttggatcttttgtaggcttcaaccctaacctctcacttcctgagttcagtgcctggaaaaacagcctcttgggtctaatcttttcttccgaagcaaggcccctgcaggcagctctcacccgggtttgccaggcttcatggcaggttcagttctacttttactatatctctaacccataagttctgctttccaagactttttctaaaattggggatcaagaagtgctggggctgaaagcctaacaaatatctaggaaggagaatctacttaacatggggaataggactttctgcatctctgtttttgaatagagattatctggagcctgtctaggttatctgctcatgctgaaaaaggcttctctaacacatgtattttctccacaaggcacatcatagccttcttgcacttaggaatactagacagcactatgcttggggggcattttaaacagtaagatcaccaacaaaaagcacaaaaatgtaaaaaccacggtactaaataggccatgaaaaggacatccttgttcatagcatgagagctgaaacaagaaggcagagcattgctctttcatccacagcagacagcaagagtgttgggtgagtcaaactttgttgctctgcaaatgtcgatgaagatcttaaaggcgtctggaatactgattttggggttacaaataagacttagcgagtgggcaaacagcaaagacagaaactgtgatgacactgtcatcacacactttgaatacaatgttttctgagtttgccgatttgtggactatcctgaatttgtgctcaatttttatctctctccaactgcttatgttttgcctctctctccatgtcaacagattacactctataagggaaaatggaaataaagatgcaggcgaaacttgaatatcggtgtgggttttgcatggcaaacactgacgccaaatttgcctctactctgaatgctcaagttgtgggagcgctactttaagatggaaatatgtgctctaagggaaataataaccagaataactttagttttaaaattatataccaagaggaaaaaaaatagtaaaaacccaactccttcttactaagtttttaaagaaacactcaaaaaagtaaaattaaacccccagagtataattcccattctaatgaccactgagcacgtcattgcttttggttgataaaataagcacatgttcttctctttacctcgaaaacttgaatgatttcaaagacaacaagtaggcagtaatttaaagtctttttttgtgagcttgccattctgctcttcgtggggatctttgtgatgggaaactgtaaatacagttttagaagtaaaagctttcatcttaatgactataggattagaaaaagataagaagctactataggaaaagtgggtgggctgggcacagtggcttacgcctgcaatcccagcactgggaggctgaggggggcggatcatttgaggtcgagaatttgagaccagcctggccaacatgttgaaagtgtgtctgctataaaaacaaacaaaacaaacaaacaaacgaacaaacaaaaccaacccccccacaaaaattagctggcatggtagcgcacacctgtaatcccagctacttgggaggctgaggcatgaggattgcttgaacctgagaggctgaggttgcagtgagcagagatcataccactgcactctaacctgggcaacagagtgagactctgtctcaaaaaaaaaaaaaaaaaagaaaaaagtggatggatattaccacatatttttaaataaaatttagcaatcctggtaattttgggttcttgattttaaacacaatatatttctgattataaaaatatttttctgatcataaaaatagatgtctttagaattaaaaaaacacataaacataaaaaggagataatttaaaaagcttataaaacatagaagaaaaactagccctaaatatttctgaaaaccaatataatgtcattttaaatggcacacagggcaataccaacatagatctctttgttcgaaagatagattttttctgtcttttaatttatctaaaaataaatcatggtgtatttttttccctccattctttacaggagtatgggtgttttatcttatcagatttccttcatggggaaaatgtatgtgacttagtcacccagccaggtgatggttgactacaggtggaccaaggaatgaaagttggcaagtttgggcactttttttatattcaattctcaggaaagagatacccaaaattatgtgtctctgctgaacaatacatacaattatgaccagcaataggagttgtggaggccatagctctggggttcaaaatgatcctgaaataaagtattagaaaccctctcatttctttctaatattggaaaagtcacatgtcttttaaaattaacaaccacattatcatgagcaattctaattttccccaatgtaatcatcacgaaaacatttgtgattgacaggttttctaccccagatgtaaatttttggaaatactaatatacaattacttttcataatgggtgcacagctactaaatgatgtatggccaattcccaaagtttcaaatggataaatattagtctaatgtgctcaatcaatgcagagaaatagctctaagcccttttcctgcaagggaaaatatttaccgtatatcacagatagattggccacaggcactaagcagtgatggagaagcctagaaatccttgtaaatgtccttgtacttcagtgaaggacatcctcaaaagacagaaaggaaaaagaaaagaaaactctgaatggtgttacctcaagcattctctaaaacacagcacttagaatcagacctgcatcagcacgttgctgcttgacacacgaaagcccctttgcatttaacaacaacacaacaaaggttacagagaacttttgatatccttcatttaccagattatttcttccatccatagtttacagcactgaattagagattgttaatagtaataataataagaaaaaaagattttgaccatggactatgatgtaacccatcatagtggatcaactgtatactgagtctgactagaaaaaaatcaaaacagtaaaataccaatcagatgcacttcacataatgttgtccttttaaattttgaattgtggtacaatatacataacgtaaataccctttggggtttttttttaagcaattaggcacacagtgtgcaatttataactgctatgaaataaccctacccctctttatttgggcaaaggtcactatggattttttttttaatttttaactgtagaaaaggatggaatttcccacctttccttaaataagaaattccagacaatcacatcatgtccattacatcccaatactcggttttgactaagaactggatgcacatctatctaactgtccaaatccctttttggattctcaaatagtgaatcttcttggaatcagtggttaaagttcccactttttcacctggaccgtatgggtgacagactccctgtttgctaacatgaggatgacagttacagatttcaatgcaaactaaggaagaattctcagctgagttgtgctgtgtagaaaacagaattggcagctttgtgaagtgggggctcccagtacttagaagtcccgaactgtggcttgacactcactgcgggatcagaatctcctggtgggcattcactaaactcagatgcccagacctcatcattaattgtcctcggtgggacccaggcatcggcatttcttaaaaacctccccaggcaattccaatctacattgaagcctgccaatccctgtgtagtcacaggctacaggctcccaggtcaacccaggtggcctctgacatccctaccagccccaggactgtggactaggacacggttttgcctaatgactgattatatcctgccttggttaagggcaatagaattgagaagattagcactgcccccaactggctacaaaaggaatggaaaagctcaaaggaagaaccatggaggtagaatataccgggagccaagaaaattgttttcaactacctgaaatgagagaggttcctctataatgatgaacaaatgacagagaaagcagttttgatctaataatgtccagtccaggggtaaatggggttcttccgctcctaacacttttgttgctctttgcccacttcttggtgtactagtaaccaccctattgggcactcagtgtcttcccaaatccacatgtgttctcagcaaaggcctgatctcagttatttacaccagcaaagtgaatgcaagtttacctggtaacctcactcaaaagtgttgcattttgagccttaactccacaaaatgaagagtctgaaccattttgaaaggaacctaaagacaactgagaaggcaaggacatctttgtagagcagaagtcttttcctgtaagtctgagatctttccatagaagcggctgctagagggaaagatgagagacagggtgaggattaatggggacaaaaccctggaagagaaagttggaaacggtacagtcaatcatgagagcacaggacatttacagagaaaagagtgaggaggtgtttttcaattccataaaatagaaaataggaagagtgagcttagatcatagcgtgatcaattttaagcaaatagacgatgagaaatacttttctgattacatagtggactgggtggcggacagaggctgaagaagtgtttaaaaacaggccatgcattctcatatctgcatagaacatccaagcattacatacgtctctcattattccaaagcattacatacatctctccttagaagagcgatgaagctataggacacaagacccagtccaggatacagcatgaaagagaagatattaaatagctagcagagagtcagatgacaatcagtagataaaaagggcttggaaatggtaagcattatagaattttggaaaaccatttttttcccatagttaagagaccccattcttcaaggccttgatcctgaataaatgtcctttcagggttgacaccctatttttatgacttaaaatatttggacgggatatttggaagtttctaaactctgctgaactaaaatctgctgaacaaataaagggaagaactctgttttgtaccatgtaatttacttaaatgccccactacagtgtaaaagtagactagaccattcacttcatgccctcaggttttcaacatgccagatgtccagttgaggaacgtatctaaatctaaggatattcctaaattcttctgcaaagtttcaaggctattggtaataacatatatttagtggtcaacttggaggctaacgttggtctttctatttctgtaacagcttgcacagtatcatgcaggcatacatgtgagtctagatgtagatctagacatatataacccaatcagtgcatttcaagtatctaattctaccctcttacaaagttttatttattgttaagattatttcagaagcaccatagataggaatatgtatgttaaatttagctaattcatgctattcacacaaatgcactactactttgtgattttattgtaaaaaatgatatttgcatgctcagtcagcctcagtactaagcatccaacttcccgatttgctgattttttgtaggtagaactgtgcatgactcagaaactaaagagaacatgtaagccctacattctttcattgaaatggtgattgcctggatcacatgcacagagccagtattcattgcacataatgtagcttccctgttctcagtgttccctggatctggcagcacctcagggtcatttaaactacacaaacttttcaaggatcctgcactttctgtctgtgtggctccgtgtgaagtagcctgttagtcccttagcagcaaagtatgagtggatcataatatagtatctgaaataaggaaactataagtgattctccacttgggatgacacctttcttgaaactcatcctctggtaatgtggaatttgaagagctgatatttgtaatctctaacttttaggagagaaggaaagacaatgatatcatggaatgcacacattataatatttgctgtgaattacgtgcttcctatgaaaagctacaaagatgaaggcatctctttctctatgtagcaactgtgctctagcaggctgttgcttcagtaagagcactctttactcacagcccctgtacaacctgggctcctacaataaaatattccaaatgtaagcttgccctctcataaagtccaacaaattcagtctctagtctcaacgttctttatctttgttgttggttaatttgctcctctgaactgatagtatgtaaaacagtattctttctctccccaggactgaatagcagaattagaatgtctccctgcctctcttctctaatcttgtaagccattggtaagttcaatatctgtttcaaacacattgtcattgaccattatccaggaaaactcaattcaccatgacctttaagttgaaaatactctttaattaaacatcaaggagggacaattactgaaaatcaatccctggcattttctaattgtggaacaattttttaaatgtcagggtccatgttcatgtaggccattttacatttttatttttcatttttattagttttccctcaattctgtatttatagattcattactcccaacaattacccttataaaaggttccaagtgtttcttttcatgtcttggattaatgggccataatttcacacctaacactttagtaaagaaacatgcttacttataaaacatacaacatgggtcaaaatccaacaaaagcttctaatatgagactaattaaattaaattgtgattagattgaaggagtgaatcaattaaataacaatggcctaaacttcaagttacacttaaagatctatatatttaaaatgtcaacaacatgcaaaaaaaatcacaccaaatacaaatatgcagacaggctacatgtagccagaaggatatagtaggataatgggccttacagatcaacaaattggagaatttacaatggagaaaataacaccaacacataaaaatactatacaagtcaagcaaaggtaaattattcatccattgaaacaaatatttattcaggataatgcctagagtctaaatttgtctaagaaaccacagtagttagaataaatcctaatttggagaaattgatcaactgattctaaagtttatgtggaagggcaaatgacttagaatatgtaaactgtttttttaaaaggacaaatctgaacaactaacactatctgcttttaagacttattagaaatgtacaattatcagaataatgtggtattggtacaaacagaatagatcaagacaaaaggatagagagttcatagatagaacctcacatatatggacaattgattttttgacagaagtacaaaggcaattctgtcaggagaaaacagtatatttaacaagtaatgctaacataatttgatattcatatgcaaataaactttgattcccactgatttgcacaaaatgaataatagatataaaggtaaaacactaaactataaaagttctagcagaaaacagaagagaaaagcatgatccataaaagaacaaactgacaaactggacttcatcaaagtgaaaagatctgctctttgaaagacactattaaaagactgaaacagcaacctttaccttgggagaaaatattttcatgtatctgataaaggacatgtaactagagtatagaaatcactctaaaaactcaataataaaagtgtaattaagtagtggcaaaagagttgaatggatgcctcacaaaagaagatacaagggtggcaaatgagcacatgaaaagaggctcaacatcgttagtcattaagagaatgcaaattaaaaccacacctattagaataaaaccaaaatttaaaacatgaagcatatcaagtgttgagaatgaggtggaggaaatggaaccctgattcactgctagtgggaaggtacaatggtacaaccactttggaaaatagaaacatacactatccaaatggcccagttattccactcctaagtatttacccaatagaaattaaaccatatgttcataaagttgtaaatagtcataacagttttatttttaatagttccaaagtggaatgacccaaacgtccaccaacaggtaaacggataacaaactgtgaaatgtctccaaaagaatgaataaaaaggaatgaactattccattgataagttacaacatggataaccttaatataatctataatctcaataccgtgtatctcaatataattaggctgagtataaaaagccagacctaataagagtacaggttgtattattctatttatataataaaaatttcaggaaatgcaaagtaatctgcattgacaacaagcacagtggttgcctatggatggggaaagacagggttgtgtcagaggaagggattacaaaggatgaggaaactcttgggggtgatagagaagttcaccgtcctgatggtgagggtggtttcaccgatgtgtacatacaacaacatgtatcagactgtacactttcaacatgtgcagttacttcaactatttccaaattacataatcctttgtttttccctcctgtccattatctacaactttgaattggttggagagctttagaagcctttgttggacactattagtggcctgcagggtctgcagtcatgggtatttctaatcttccttgacctgctttgtcttcctttggttcccacctttgttgctgttataagccctttaatcactgcactactagatgccatctagtaggacaccatgttccccatctttgaacatcttttccatcttcttttccaattgcagtgcctgtttggccctcgtttacctccccagctctccttggctatactaattcctcttaattccttcaacataccctacttcaccttgatttggggtcttcttattagaagttctctatttctggaaaactttccttctaacctctttgatcctggctaattcctacttattctttaggcctcagctgcatgttgttttcttgggaaagtccaattatttctcccaccaaagtttggcttcagtggccctgatagaagaccctgaacttcccatcagcacttctccactcaattacattgccctgtttacttaccagtattcctccagggcacagggtcacctcaattcagatctgattagggacctgatgtatatcaggtaatggggttagctgttggaggctacaacttccccatttcctggagtaaatttaaggatatgtccaactaaaaccaaaccaaacatttgtttcctgcctgtgagcacaacataagaaattcaaactaggtgaccaactgtcttattaaacttccatttgtaccaaaagcaacttcttactgagaggacattttggtcctgagaaattcttccctgtagtgttttaggataaggacatttggaatttgaaattgcagtctactgtgtcattttctcaaacctggtcttattacactctagccaaagaaatatgaaatgaagatctgatccaatttgggacccccaaaaggaattgtaatgaaggttatatttcaaattatgtaggctggttacatggtcagtatgtagcagctgactgcctggtgttttattttgtttgtctgtatagatatagcatatctaagaaagacaacttcattttatagagttagaaaaacaacccttgagatttattaggaaagtcttgtgccagtccatcattcctgtaaatatacacgttgatcactaaatggtaagaaaggtgataggaactgaaataaccaaagtaggaaaatgtcacaacaaactcttcttgatcttctgcctgtccctgtacttggctcactgtgcaggaaagagttcttccttgggttaaacaggagcatgctcagcctgaagcagagatgatatgcctttcaattttgaaacacagtttccattgtgtgtgacccattatgtgtgacctcatttgtgggtgattaaaatgtgagtgattagaatgtgatgtcctcatagttactctctcactccctttgaatttcttggaataagtaaaacaataatgtaaaatgaaagttgctgattttttatacctcagatatgaattgctgataaacattttatttagggcacaaccaattcatataaatttaaaagtaaccataagaaatggatttttcagttacatcatctgtagtttttacatttaacctattacaaaataataaatcattgaaccatattcttttcagtgtcataatcaatgccagacaatcaattaaaaatttaggcatatgtattaactagtatagatcaatgtggcttgaatacacaaaatacgtccaaattctgtccaaggtaaataattatgatgctacatggttgttgtgtatatatttcacataaatttagaaattagtatttcaagagacattacaagtcattatgttcattctacgtctcaaacatattatgggaacagaaatacctttatttataaatagcatgtatcccaaaaaaatctatgggaatttgaatggcgggcatccagaaacttcatgtggtcgccagtgggaagtatatttttgacaagccgcatacacttagggccagccacggaagtagtgccaaaccaatgatgctactgcacttttacttagcttattgtgatttattgcaacagttaattctggctttctgtttcagaatgatctagtcatctatatttataatcattttaaatgaatatgtatttcatgttttcagttattcatgatcccttaaaaaatataaatgccttactgctagacacataagaagattaggttctataatagtaaaaatgccatcggaagatgagagaagagaaattctaccaaaattaggtaaaaagataaatttttaggacttcaaaaataaatgcaaggtggaagcaacaagccaagtgttcactgatgaatgactggatctgcagcagcccatccatacaatggaatactgtccagccttgaaaagagggaaattctgacccagcctatgacacaaatggaccttaaagactatgctaagtgaaataagccagtcaccaaaggtcaaataggtatgattgtatgattccacctatataaggtccttggagtagtcaaatgcatagaggaagaaagtaggatggtgaccatgagagaatggggggagggggaggagaggggaattggtgtctaatgggtactgagtgtcagtctgggaagatggaaaatgttctagagatgggtggtggtgatggttgccaacaatgtgaatttactcagtgccactgaactgtacatttgaagtggttaaaatggtaattttaggctatgtatattttaccacaataaaacaataattagaagatataagtgtaaaatgtaaaacatgtaaaagtgttaaaagaaaacacaggagaaaaatcttcatgacctggagttaggcaaataattctgaggcctgataccaaaagcatgagccatagaaataatttgataaattgtattttattataataaaccaattttgatctgcaagaggcactattaaaagaattaaaagactaactgtaggctggaagaaaatatgtacaaatcatgtacctaccaaagaatttaaatatataaacaatgaaaacctctgaagattcaacagtaaaaaaaaaaaaaaaagaaaacaatttaaaaatggataaaaagcaggaggatagcttgaggacaggagtttgagaccagccttggcaaactagtgagacctattgctacaaaaataatttttaaaaaattagccaggcatggtagcacctgtaattctagttacatgggaggctgaggcaggaggatttcttgagcctaggagtttgaggctacagtgagccatgatcactccagccagggcaatggacagagcaagaccttgtctctaacaaacaaaaaacaaacaaaggataaaacagacattttgccaaaggagatatataaatggcaaataagcccatggaaagacaatcaacatcactagtcattagtgaaacataagttaaagtcctgaccaggtatcactacatgcccattagaatggataaaataaaggccagataacaccagggctggcaaagatgcagagcactaaagactccaaatgacaagattgtatacatagaaaatccaaaatcatacaaagcattagagtgattccctgacagccacacgattcccacctcacctctgccaggcttagctctcatgttgacttttcagggaaatctccaaccaccaccttgtttaataaacattgtaatgcctctccaatccattctctcaatcctaggtactttatctcccctctacaaccttagcatatgaaactaaagtcctatttacataatttgtatgtgtctagtcagtttctaccagctggaatgtaaaccacatgaggacacacatctctctctctctctctctctttttttttttttttttttttttttttttttttttttacagagtcttgctctgtcactcaggctagagtgcagtggcacaatctcagctcactgcaacctccaccttccaggttcaagtgaatctgctgcctcagcctcccacgaatctaggattacaggcatgcaccaccacacctggctaatttttgtgtttttagttaagacagggtttcaccatgttggccaggctggtcttgagctcctggcctcaagtgatccaccagccttggcctcccaaagtgctgggattgcaggtgttagccaccacgcccggccgaggacatgcatctttgtttagttcagggatggaaagcagagcctgtgtggcatctagaagacggaacactcccagtacatacttgctgagtgcatgaaggcagtctcaggttgtattctctccagctgttggactattttccccccatgaatcagactaaaataccccaccactggtttggtcatccgctcagctaactaacctaatttcccctcatactctgactcgtgctgccatctttcgtcagtttacctgtgttctctacttaaacctcaccttagattttatccactccctgaaaattagctttcttggtttttcttctttatctcacccgctgaatctggttactctgggattcgtttcgtgccctttttacagtcttgtcccacaggtctcatctaaatcaagggctttacaaactgtcaaatataagcagaaaatctgcacacccaggtcctccggttccccacctaggttagagctgcctcatggtcatctccctgagcctgtgcagtaccacaccaagcccaaaagtgcctcatccggtcatttctgaccagtcctctggtctgacttcccgactgtatccctttctctgtatccaaatgattcttcccatcacccagggctcaaacgttgcaatgatctatgcttcctcctccatcatacttcacatctgctcagctataaagagggttgttcagggtccctcagcagtaccacgtttctcagttacatatgtgctttagaatctacaggggacttttcaaagaatgtggatgattgggctccatcccaaatatcctgatttaattggtttggggttgagaataggcactggcgtttcttaaaggttctctgggtgatgccagcatgcaacacaggatggaattcactggtgatgactatgagctttggagtcatgcatccccttatccaaattattgtgggcatgactgtttgatatgctggagcctcagatcctcaactatatatagaggctcctcgacttacaatgggattacctcccaataagcccattgtaacttgaaaatatcataagtcaaaaatgcgtttaatacacctaacccaccgaacatcacagcttagcctagcctaccttaaatgtgctcagaacacttactctgccttgaagttgggcaaaacaatctgacatgaaacaagttttataataacgtgttgattatcttatgcaatttattgaatactgtacaaaaagtgaaaaacaaggttggattggtacttgaagtatggtttcaaccattgtgtatcacttttgcaccatcataaagtcaaataatcatatattggggactgtctgtgtagggattctaacatcagcctcaaagggttactatgtagattaatagagataaatatttgaaatttctaatgataaacggtaggtccttgatatataataattctctgtctcttcagttttcccatctgtaaaatgggaataaaagtactaagttcactggctgcattgaatgaaagtaaagttcccagtgaggcacctgtccctaactataccgtaccaagctaaagggacagatggaagacgctttaccaggttagacaaaggtttctttgtaaaccttgcttctttgtccattctcattctctgcatttctgtggttctactggtgcatacccctatgttgttgtaccttcttagcttctactccattgtcagattcacattactaatgcagagctccaaccgtgtcattattaaaactcttcaatggctcttcactgaccaccacactaatcatatgctcctcctgctgtcactggaatggaacaaatcagtccttctagccttgcttccagtagccccactctttcccctgcataccagataatgtggcccttcgctgttccacacattgcagcccactttcattcccctcctttccccccacatcctcaattctacctaacaaatctctacccatttcgattcatcctgtcctaatgcactcaacatcaactggatgctgtcatggctttcacgggatccctgggggatatcatctgaagaagccccacagaccaattcacacctctgtgccctctctcaccagcatagctttgcccatgcaagatcccacccgcttttcaggacctagctcaggagtcacctttctgaaggaaactgtcgctgactggcctcagtgggtcttgtgcccaccaaggtgctcccataacaccccgggttcacgcctctcaaaatgcatctcggacacactgtcaagctttgcttcactgtcatttgcttcttgacagcagcaagggtgccttactcatctgttctaggatgcaactggcacgcaggaaggaatcgataaacgaaagacaaggagagaaaagcagcattggaacctgtgcttgcagtattccaggtgactttttttttacagtctctctctgtcacgcaggctggagtgcggtggcgcaatctcggttgaagcaattctcctgtctcagcctcctgaggagctgggattacaggcgtgtaccaccacacacagctaatttttgtatttttagtagggatggggttttgccatgttggccaggctggtctcgaactcctggcctcaggtgatctaaccgcctcggcctcctaaagtgctgggattacaggcgtgagccaccacacccggactgactcatttattctgttcttaaacattaaagaaatattaaacagccagaaagagaaatttttaatgctgtttaacaataattaggaaaggcaagaaaactgtatttttaggaaaagcgatatcgaaaaactttatagaatttttcatggtccaaattctgatagtcacatatttctcataaagctttcaatttttcctgtctcattgtcggttttatacatgtgtttggtagatttgaagcaatgctagttcagtttaaaaaatattgacttcaacattatagctaatttccaaggggatattataccatctagttaaaaataacccttggaaatgtggttacttgtgttatttacacattttaatgttagcaataaaatggaaggttggttacatttaatgaatctgtacagttataagagaaagacagagattaattctgagtaggtcgttgctgctataatcaatagagtacatcataattgtgcgttgaggaaacgccggtatgctaaggcaaaagaacaatagtcatcaaatgagtggtcccttgggagttaatgaagaatctctttctccaataggaaagaaatgctttctaaaatttataataccatatggacacccacacatatggatggctcataaatgctctacatcaaagtgttatttttacattttcgacacaacaaacacactaaacaggtgttttaaatgtcacactttgaacagcagtaatttaatcagcataaaaaattcttagtagtatcattgaaatattagtgggatagagatgttttatttgggatatgcttcaactatatattcaaaggcagttttcgattttaacaaatttaatttttgtactctaagatcagactttccaattcagtgctctaattcctgtgcaatttgacagcagaccagtcctcatcctacacctccgtcactgcctgctgctttttttatccaggcaaggaagcttcctagggcttcaaacatacaatgaatccaaaaggactctgttggttactggctcttaacatttatagattagaaattctccttaataatgcccttctctgaaagtctaaaaatgatctaaatattcaaaaacaagaaaatgactatctcaaaactcacatttcatttttggagtatgttgccctcatttaatgatataatagttttagtgtctagaatcatacctagcatctggaattaagtgtctgattctaactatgaatatgattcttctcaataatataaaaaattataatgatagaattagtgaatactaagtttagtgagaagaccagaatatgaaattgtgcatacggcattgaaacactatgtttttagaagcttgtgaattttttaaaaaatccttaaaaatgactgtctgatggttgaacttagggaacatttattttataatgtctactctagtgtttcaataattttcttttatggaattataaaactttaatgtgaatttaaacatccaaaatattgtaaatattactactctttctctttgcattttaccactgccccaattacctttttcttttctttaaggttctgtagatttggttgatttcagaaaaaaaaaaaaaaaaaggagaaacattatagaaaattggaggattctgtgtatgggggggaggtatttctggacttagtgacattgcaacaggaacgtcattcacttaaccgttctttcaacagatacttactatattttcaaaataattaaacaagcaacagtaacagctagtatataaagagctccttctatgttctgcattttatgccctagattatctcatatatcattagagcaactttgtgaggaaaatattaattttattataaaagagaaaatcaagcctagaacgatgcagcgacgtgccccaggttgcctgtaagcagtggagctggtttctagagcccacatggctacgaataatgttgcccgatgcaacgagggaagctggaaatcccaggtgaagaaaacccagtctctgtcctcaagaaagtgaagaatctaagcaaagctttgcagcaacacttttagtgaaggaaaggttacacatctgtgctgtacagcatgacagccactagccacctatgacaactgagcacttgaaacgtgaattttaaattgtgtttaattttaattaatttctacttaactttaaagagttaaatatgactagtggataaatgattggacatcttagttttaaaggttgaggaagatataaagaggcatttataaaacactgcaggagctaatatgttttaaaaataaaatagtaatccaaatactcttgggaaaggagatctctgctacaattgcaatgtatatatgctgctttctgagaataatttaaagtttctcacttcaactgaaaatacaattttaattactttaaatgaaaataactggcattcaacttgttagatggcatatatttttatttctactctaacatgaatttatcagactcaattaattttatatgattgtgcatgagagctcttttttcagagaaaaagtagaaacatttcttgcttttctctcataacacatactttgtaaagtaccaaagtctgaacaaataattcacgtggaaattttgatattaatttaacctctaggagtacaattctaacctttgttctaagcatacaaatactacattttgaaagaagaattgtgggccaactgggtatgtatttagtttggttaatagcagatcatgagactcaataatctgaataaagagcagagactgttaaaagccaaacacttcacctgttatttccctttatttattgtatttgatttgctgtctccattaaatctcaaatcccaaataacctcagagtttccatgtattaagctttaagcattatataagaattctatatgtaaaacatctaagacaaagtttaaggatgaataaaattaccccaaaacatacaaattaccaagataccttaaatgtctttggaatatagcacaatataaataaatatttttgtagaaacgcaaatatattagaaaagttattcctcataagcaaaattatcactcttcctcaacagtcagtgcttcatggagatttcagtgagctttctgggtgaacttctaattaaatggcttccatgattaagtgtaactcagctcagaaaattggtatttgcatatatttgacaaccaaaaatgacaagcattggaataattccaattaaaaaaaaaaacctacagaaaagagagggaaaaattccccatgaagctttgtcaattgttcaattccttcatccttaaaaaaaaagaacctagataatcttatgtcatccttaaaacaatagctatatagatggtccctgacttactatggtatgcctcaggatggttcagccttatgatggtgtaatgctttcagcacgctcattcacttcccatggggttacatccacgtaaacccgtcctaagttgaaaataccatttgtgacttaatgatattttcaatttaggatgggtttactggaacatgacaccatcataagtcaaggagtatctgttgtatgttttttcttcttcttcttcttcatatcctcagttttaagctaagaacataggcatggagtgtgtgcatatctgtgtgcatgtgtatatgactgctcactgttctacaggcatttaaacatcataagaatgatttgatgatccagtcttctgttagaggtctagacatattccacttctacacttctagagaactgttctaggccatctgccaacaagccaaagctagctgctcaccaccgggctctgtccgcaggagtcacagcaagaaataagacattttcttgcttcttgaatcttgaatgtgcctgcctgcttaacttccttccttcttttctttcttccttccttccctccctccctctttccttccttccttccccctttccttcttcccttcccttccctttccttccttccttccttctctccctccctttccttcctcctccctttccttccttcctcaccccttccttccttccttccccactccctccctcccttctccctcctaccctcttttcccctttccttcctttcttccatttgattgtagacatggagaaaggatatttcttattcccgttgatctgaaagacaaactagataagaaatctaaaaacctatcttttcagacacttaaaaaaataggcacaaggagaggggtcatatcatctgatcattttcattatgtatcattgtttgggttgaaaaacatgaaaagcattccaaggacaaaagacattacaggtctggttcctgcctttgatagttttactgttagaatggaagaaagggaaatacatataacgatgagaaagcagcacgatggtaatgcaaatggaggaagcattgttactacagtaaaaatacacactgatgcatgtatacattatacatgaattaatacatatagaaaggtacatatatgcattgtatgtctatgactgtgtgtatacagaatgtgtcagaagagaagtcgtcatatgtggaaaagaggtttaactgcttcagaattcaagatttgtctaaatttgaataataataaatacatttagattggcagaaaggagaaatttagaagaacaaagttgagaggagtgatggttaatactgagtgttaatttgattggattgaaggatgcaaagtatttttcctgggtgtttctgtgagggtgttgccaaaggagattaacatttgagtcagtgagctgggagaagcagacaccctcaacctgggtgggcaccatctaatcagctgccagcacagctagaataaggcagcagcagaagatggaaagagcagactggctgagtcttccagccttcatctttctcccatgctggatgccttttgccctcaaacatcaggctcctagttcttcagcttttgactcttggacttaaaccagtggtttgccaggggctattgggccttcagccacagactgaaggttgcactatcggctttcctacttttgaggttttgggacttggcctgatcaccactggcttttttgctcctcaacttgcagaaggcctaccgtgggactttatcttgtgatcatgtgagtcaattatctttaataaactccctttcatatatacaacacctatcctattagttctgtccctctagagaaccctgactaatacatgaggtgaggtaacaactcagttagcattatggtaacagagaccagatattgaaagtgggaaatcacttgggagaatattcaaatgtgggcctcaagtaaatgaatttcacataacaagcagtaatggagtcactactgacacttaaaatggcttaaagttaggttattagcaaataggttattctaatagaaacaatggggtcaactggatgaaatgtgggcaggaagctgggttaggatgttgctatactgactctgtaacacataaggatacattccgtatcttagctcttaatactcctcaaagaacatctatgacacctttccatccagtattagaatccattttacgatacttctgaaactagtccattcagactctcaaaaaaaccttccaatacctgggagcttatgatttctctaggagtctcattccatttttcaatagcactaattctaaaatttgtttttattttgaatataaatctgttccttattaaatttacttccatatggatctaagttcttctgtaagaaacaacacagatgaactctactctctttttcacttgataggactcaaatatctaaaaacatatacgtatataaatgtcatgactatctcacagattctccccaatctccaccatatctgttctggaataaggaaaacaaaaacaaaaacaaaaacaaactgtttttgtccttgcactcagacactcaacacagaacacttctatgaccagatggtggtgggggggacttgccacatataccaagcagttctccagtggacaccaactgggtatcctataattcaactcgattctgattctacctacctggaaatagcatcagatcccacagattgagggctcagccccacaagactagagacctcaatcacaagttggggccacctgtacctcagaccgatgggctacaaaccaaggttcccacaatttcctcaatgggtaagattaatttgctggaacagttcacagaactcacagaactcatgaaaacacttatatttattggtttattctaaggcattataaaggatgctgatgaacaccagacgaagagatgaatagggtgaggtggggggatgcagcttccatgcccttgctggagctgccacccttgcagcatctctacatgttcagtaccccagaagctcatcaaatcttgttgttcaagagtttatagggagcttggtctctagtacccccttcccagaggtcaatgggtggggctgaaagttccagccctctaatcttcaaattacttggtctttctgggccaatctggaggctctctagggggtgcaccctgagtaaatgcattagcataaacataagagttatccaaggggctaattatgaataacaaaatatactactatcactccaaaatttccagaggtttttaggacctctatgacagtaactggggacaaagaccaaatatagttcctattacaccacagctcttcttcagactagactcacacatttttcaactgttccttgtacgacctcactgtccatcactctggctcatactcacttgttcacatttatgctgctctaaaaagggtgctccaggtttgtaacaccgtggtatggtttgactctgtccccacccaaatctcatcttgaattgtagctccataatccccacctgctgtaggaggaacctggcgggaggtaattgaatcatggggccgggtttttgccatgctgttctcgtgggagtgaataagtctcatgagatctgatggttctataaagggcagttcccctgcacacgctctcttgcctgtcaccatgaaagatatgtctttgctcctccttccccttctgccatgattgtgaggcctccccagccatgtggaactgtcagtccattaaacttctttttctttataaattatccagcctcaggtatgtctttattggcaacgtgagaacgacggatacacacggtgattcacagtggcttgatctgagcaaaatacactgtaattcaatattagcaatagatgacaagcaactatggccatggtgaatctcagatgctgaaaagaggggaagaaagagagccccagccctcaccataaggcttagaagggagtgctatggtttgaatgtgtcccctccaaaaatcaggtgttgccaatgcagtattattaagaaatggcttctttaagatgtgattaggccacgagggctcctcccccatgaatgggatttagatacttataaaagaggctttactccgcattaggctctcttgccttttgccatgtgaagacacagcaaggaggtgtcatcgtgcaagcagagagcagccctcaccagacaccagtgctgaagtctttatcttggacttcccggcctccagagctcagggtgataaatttctgttctttataaatgacccagtctgtggcattttgttgtagcagcacaaacagactaagacagggagtgtccatgtactccatgtaaaacactttttttaaatggccatttaagaccgtaaacacagaaaagagaaaaacaaagacaactttctcatttactttcacacttacaaaacagttctcaaatgaacacacagagattagtgaatgcattatgaaagaatgaagatggtaagacacttgttcttattcccaggacagaaccggtgagagatgtgttcgcttttgttccccaccgccaccccacaaagacacatatcagtgtttacttccttgaaattggcattttcaggattggaatatccccacaataaacttccagatgcctgcacatctttcaaatacggcatcttaaggatgccatatttgaacggtattcttaccattatccttcccgcctgcttcctaaaacactttcataaccagagataataacattcctcgtctacaaggcagctgcatgccaaagacacaagcagctgcacctccgctcagtccacattgctgggtttttataacgaaaatgtgcacattagacttttttatggttttgccttcctggaggcggagtagctctgaggtccatcattcactgatattagaaggctgcctgtggtaacacagaacccaatgtagcagataacaaaaggcaaatataatttgaatcagagaatggcaggactggaagactcaacagaaaaaatcccgttgtcttcctgactttcggtgatgatctgaattacctctgaatatctggaacgccatagcagccttttcttggtggtgggattatgcgtatttcttagttctcttatttttgtttatctgtatgttatttttactcagtgaatatgtatccctcttcaagacaaatatatgtgttcattaaaaataaaggagattaggttagtcatgatagttttatgttcatttaaagatgtgtcctcctaacagcttttatagatttagggtggctggctagttctaaataaaaactgacattgttccttcttaaacatgcggtgaaaactagaggttcaccactgttgcccaggccccagtttccatccagttgagttaggatgttgctcagttaaatctcagctgacagaggacgttacatagccagctgtggctgagaggatccagtgtttctagagctgatgcagaaccccagtcactggggggaatgacgggaagcttctcagtcctcacaagctcccctaccatccactaggaccctctgctctgctgtttgccagagcagtagctctcagggactccacaccagcaccatcagcaacatctatgaatttgttagaaactcaaattatgatactccaccctagacagactgggtgagaagcgctggggtggggccctgtgatctatatttaacaagctcttctggggaattggatctggtttagcgacacagccaccatgctgtgctgggcccatcttaccgactcctctcctgaatccccccagagctcctctaagcaccactgtgtctccagttcctggtcaaatagaatacagaggagactgggttaatttgatgctcacagcaaccttgtatctgatgctcttttcatattattgctgttggagtaatattctattgccagatgtcagtgctgataaagaattcagaaatgaggaggaactagaggcattttctgggcctctgctgtttctctttatttccaacatgccactggcatgaaatatagctggctgcattgaaagtagcagtgcttttttccccctaaatgtatagaaatctgttttccttatgcgtgggtggcaatttgctgctggtagcttcaaaaccatggctgcactatgaacaaaaaaaatgctcttaccgtctcagccctgttaacctctttctcccaaacaaacaaataaacctaaacgctatgtctaagcccatctgtcaacaggcatttactgagtacctattgtgtttaagggattttatgtgcaaggtgtctcaagagggggggaaaagaaacaaaggctatgtacttaagatattttcactgaggttgggcagacaaggcttgagaacaattatcaggaaatctattagaccaacaatggtgaaacaaaacagtgccaagtggacgctggaaggcagcggcaatgcagtgggggcagcgtgggaggtgaagtggcccccaaggtggcatggccagagcagaatgtgatgagagaccaggcggctgggaagaggccttcagcttagaaacaataagcaacagggaaccacttggagttcttgagcgagggaaagacaagatgagcctggtaaccataattagagaagcatcacactgaagtgtgggctggttatcggagggtaacacgggcatgtgttctaattgctgtgtgcagagcatgtcatgtaggctgggctggccaacacccagctgtcagaggtcttatgttctactagggacagatgtgaaacaaccatggcaagaaacacacaggatgtgttagtccatttgtggtcctgtaacaggctaactgagatggataatttataaagaacagacatttctttcttacagttctagactgggaagtccaacatcgagaggaggccatccagtgcgggccttcttgctgtaccagcccatgatggaatgcggacgggcaagaggactgagaatggcatgaatcccccttcacctcccaaaggtcccacccacctcccaacactggtgcatttccacacttgaactttgaggagcacattcaaaccatagcacaggataactttacaccataataagtgctgtgaagacactagaacaccatgagagagtcaaagggtgggggtcctgcttcaagacacatctgtgttctgacatcgcaccaagggctggtctgtctacgagactgtggggagcaggaatatgaggaggaagaagcagattgcggagatggtggggcggtagagggaaatgtcttccggtgttcctaattcgtgaatactttgattcttattcatatcttctggtcagcaaatcaatattagtatttgtatcaatcataacatctcacatttgaattatactttgtagtagccatgataactctgtgaagtagacacagaaactctttacacaagaccttctaagagaggaagggggtgcctgtgtgtcacgcccgcgaggggtgggacttggatcctgcctgagagttttggcccaggcccgcttccatcccgctgtgctcatgcaggcagctttccccttccatggtgagtggagcctgctcaggtcctcagtgtcattgtgcatgagagtgaagaggatgcccagagggaaaagcgctcagctgtgtgtgtttccagcaaaacagacgcatggcagaacgtggggagaaacacatcgaccagagctagctactacgtatcactaaaattgagccgttttataaatattttatattcatacaatgtgccttgcgatggttggaagatacatttttcaagatggtcttttttcactgcccttagttgagcctattaataattaaggtaactttcttaaatgagaaaacggatttgaaagccaggcaaagtgttgtgtactgggaagagaggtttcacacattctcaaggagcgtccatagcaatcaccaagaggcacctcaaaccctggcatccagggtgcaactgcaggaagactgagatgggcactaaacatcattcgcctaataattcccatatgactcagtttccctactgagactgatccagtgtggaggacatgggtgctacttctttatatcccacactagagagtgcatgtagaaggtaattgacaaatattctttggaggcatgaatgatggtgccttgggaaccaaggaaactagtcaatgaaaaaaataaatgagtccacccaatttcagggggctagagatgtgctgggcaaaggtgtggccttctcagggtcattctcattccctagggtgggcaccccgagagaaacagcccagtggcctcgggactatccctagcaggcacctgccagtaaggctgcacccataatagacaaaccctctgatggcctgatacctgttgtaaacaggttattagatattgtaaatatcactctttctggaaatgatgggtgcaactggcttttaaatcttcctcccgttcagtgactcaagaggtcttctatccttcaagtgtgttatcctgcagaaaaaaaatttaagaataactgctccagaacatcttctgagtctcatgattagagggccagtgaaggggctttagcggcatctcacaattatagataatctcatggagcaggctaattacattccaatcccttcactcataactaagactgttatcaataagcctgacattattgctgattacaaagactttcttatttgctcgctgtttaattactcagcttttaaatgttccttgaagaaaaactagaaaatggagataaacaaaataagaaaggggaaaaaaatcacccctcatcgcctagcgaagggtacggattgccaacattctcgagtctctccttccagagatttccctgttgtgctgacagtcttcattaatggagttttttttttttaagtatttttaagtatttctcaagagttgcaggagaaataaagaaagtaaagagagaagagaggaaggaaaaaggagaagagagggcaagcaaagtttcagaagactaccttgccaggcatctagtgtagggtgggcaaatgttttctgtgaaggaccagctaaccaacattacaggctttgtggggcttgcagtctctatagcaactacccaacaacacctttgtaccacaaaagctttcttgtctgcaacactgctttcagatatgtgactagggctatcatgtgtgattatggacatcatgatataatttaagtcatctctgtgtgcacatttaaaaatcaggaataaaatgaattgaatataatactatttagcctgtatctttcatagggtgtccctcttatataagtcttttgttctcctatcatgataagagaagctcatgtaatactgcctgatgacccttgctaatccaactcctgcgttcaagccatcctcctgccttagcctgctgagtacctgggactacagacatgcaccaccatgtatggctattttgttttttaaatattttgtagagacggtttctcgctatggtgcccaagctggtcttgaactcctggcctcaagcgatcctccagccttggcctcccaaagtgctgggattataggcataggccactgcacccagcccgctgttctaacccacttcactgagtccgtggctctgcagtctttctcgtgtaactccagttttgcctccccgtttgcactatgctccagttttccgtggttctgcttcctggtcttactaggattacagcacaacaaaccaacagagaaaaccattggattccactggaaagtcgaaaaaaataattaaggctaaagtataagaataatcacaagcctgaagtgctgccacctgataattattaaccatactaacaataataaaaaacattatcaacaattaaaaagttcaaaagagtagcagcagtcattaagagctaatcacccaccaggtatgacgtgaaggtcttcatgtgcattatctcatagcagccctaccacaggtaactactatctccctaccttatgcaggagggtaactcacagctggtacctggagaaatctgaacttatgcatcctgaattgggactcaatgctgtcaatcctcctgtgccccgacactgcagggtctgctctggaagcacatctggaggcaccgcaaactcatctgccccacatttcagagggcactgatgggcacaggtgggggggggcaggtgggcagaagaaagtcaccccctgcagagaggaggcctggcattcatctgagaaggggctctccatcctacagacaatgtgcaactgtcttcatcaataatattgaaggtttaaatgtacagtttcctaaccaggatgattaagaaaaatatctgtcatcaatgaaaatgccctttgctttcaaaatagaaaattctacaagaagttagtatattctcataggtacttttaaaactatttttttttttttaactatttttaagtcctgtatatttcttcattcatcctgcaaataaagatatcttgaccttacaaattagcaaatgttgttctcaatcagttctactccaaaagagtaaagagagattaagtgaaccttatcatttcagaagtatgcattacttcccgttcataatgcagacagactgtttttaattaaagcttttggacttaggctggattttctagaggaatatcatggaaaaactttcccaatggttggtaatcacatttgatatgaataagatgaaggtgcgacataacatccgatccatgggcagaggtccctcaagtttataaagtttgtcgtttgggaaagataaattgttattgttgttatttttaactaaacagaaaagtcaaattaaaatgtgattttgatccaactgtgtatgtataaaatgtataaaagtataaaataaagctgtcccttgaaatatgaccaactgatttgtaaaagtcaatttcattagaatatgcagaatagagagaacatttgagcatttttatttcaaaattcactttgctagtgcatttaggaccgatgtgagggtgggatacatagtttctctagcagggcagcatccctgccttgcccatggctttcctcgtgcctgcatctgctcaagggccagccctcctgactaaaaacggagatgccagatctacatagaggacactagagctttaaggctaagtagtgattatttacttcttgataaaataataaaaagtaataaaaaataaaatttaaaaaggcttctaaggccagttgtttatgcagtcccatcacaccagaaaacataaatggattttatggacgcacctgttcagggccctctttggtgggctctgggtcccccccgtgctggggctgcgtggatggcccgtcagccacgccacccaccgtgatctgctgccttcagagggctgctgcctccctgggtcatggtgtcacccctactcggtgaacagaaaaaagttcaaacacttaaaaatcactgctcccaaacacagttctgcttgggtaagtggcagattccatgtgaatctcagtttttacagattaagtggaactgtttgaccccagctttcaggtccggataaaatgagaagtttttgaaaaggggattagaaaaagaccttagaagcacttggtttggaagctaattttttccactcagactcacagggagggaatccattgaaagcaccaattactccttctttcatagtctgggaaactggcctctaaatctccgcctttactggtaagtcaggctcagcaaccctccttaggcttgagttaaacaccttaacacctgcctctgctcccaacatgcacacaaaccacaaccaaaccaaaaaactattttctgagtatatagaaaattcggggggaaaagcaggaaagcacaaatccccataatgcccccagcatacaaatatcataatatttttgtgtgcattgatttttacgtaactggattcataatgtatacattattttacaatatcattgtacttagtatatttcatattagtaaatacttatctacaagaagggttttggtagcacagagttctcctcctaacactgtattataatttagttagctcagcacctgttgttgaactctgacttgtttccactttgtcacagctataagcaacgctctacagaacaatgaacataaccctggctacatatctggtaattttcttaggataaatttctaacagtctattttctggtccaaacgtgtaaacattttcaatattttgatatatcagcaaatttctgccccacgaagttgatccaatttatactcctgtcagtattttttgtgattccatgaatccagggcaaaatggaacattgaatgcatttaaaaatattttataatgagataaaaatggtgttttattcttcttttaatttgacattaatttgtctatgcctcttatttaaggaattgtttggtcttgcatttttacaatttttctttaaaaattctctaagaagtttttctttttgaggtcattgggttttctctcctgactttaacctttaaagatttccctctacttttagctcttgaaacatctcccttagacctttaagttctcccattctcctaaaaagagtcctcatttaggagttaaacagtgcacgctggctgggcacggtggctcatgcctgtaatcccagcactttgggaggccaaggcgggtggatcacttgaggtcaagagttcgagaccagcttgacctacatagtgaaaccccatctctactaaaatacaaaaattagctgagtgtggaggtgagtgcctgtaatcccagcttcttgagaaggtgaggcaggagaatcgcttgaaccccaggaggcagagtttgcagtgagccgagattgcaccactgcactccagcctgggcaacagagcaagactccctctcaaaaaaaaaaaaaagtgcatgtctacatgattaaagtgacacacaacagatcactgtttattacaaatcctcatgtcttttaaagttcatggtaatatgtttatgttttaacccaaagtctctgttcctctcctattcccaccactacttagagcaaggatctttgcattggaaagcattggtgtgggaggggaaacctacagtttctgctggggtccccatcttgcatattttggctttctggctcctgttgttggcggctgggagaaatgacctatgcagggtccatgggcagccctagaggttgaagttcaaactcagggatgaaagaaagaaagacagacactttctttcacgactgtagacatgatcaatggcctgcacaaaaatgagtctatcactttacacccagggccactagtcaccttggaaactgaatcacacactctctgaaaaaagaaagtggagccacagatctgggcacagtcctccccatgctctgagaatccacgcaggctgcctttgccgctcccttctttctcctctcatgggtgtttcctgtggatgcttccctcaagctggttcagcagacctgttctgccctcacggcctcaacagggaagacagagaacagtagggggctcggtcttcaagacacctgtctccaccaccctctccactgcgcactcacctacagctccttccactgtgagtgcgtggaagcagctccttccattgtgagtgtgttttagaaaatgtgggaaggtagatgtttcagcaacatttctccattcagtgatgctgggggaagtagagcttcttgcctggtgagtctgcaatgtctagatttaagggtccccatctactgtccctgaaaggacgggcacatggaataagagtccttatctgccaagtcctagtaatgctactgcagaggggaacggctgaagagctaatagctccctttcatgttaaatgattcaaagtgatcgtgaatagcatattttgatacaaggatattgcaactttctaaatttgaaaggatatacatgtgctaatgcagaaaagcttatgtatggacatactacaagtgacagtcatattctgcatttgtaaaagagacctggttgaaaaatatggtaagcgttcatactttcaggaattgcttctctctcagggatggtgcctctgatgatagtgtgaattggaaagctgaaaaattatactctcagtactgctggttacatttgcaatttctgctcaaattttgatttgtccaaagcctgatacattttatctagccatctaatatcatttagtttctggatgctgaggctgtaataattttcatagcctctgtactaaaatgctacattttgtttttctttgtattttatcatgcagggtgaaaaatatgaacacatttttataattctgggaccagttatatacccggaggtctggcaattactagaattccccaccaattattagaatgataatatcaataactaaagtttaattgtgggtgatataatttggatatatgtccctaaccaaatctcatgttgaattgtaatccccaatgctggagatggggcctggtaggaggtgtttgggtcataggggtgaaaccctcatggcttggtgctgtcttcacaaatagtgagtgagttctcataagatctggttatttcaaagtgtgtggcacctccccttcgccccactgtcttgctcttgctctcccatgtgagataccacttttgcttttcctcctgccatgagtcaaagttccttgaggcctccgtaggagcctagcagacgctggcgccatgcttcctgtacaacctgcagaaccatgagccaatgaaacctctttcctttataaatgacccagcctcaggtatttctttatagtaatgcaggacggcctaacacggtggataaatgttcaaatgattaaaaattttgtttaatgcaaacatttaaataattcaacaaaccaggtctctggaattataaagacaatgggtagggtaacctcagaccagttcactagatcataaattgattgaaggcagtagactcaggacaaataaaagtaagaactacattacttggtgcctgatgaagtggggaatcatttatcttcaaagatagtaccacctaaatatttcattagattccagaagggttcatggatgatagatgcagaagtgatttgctaaaggcacaggcagggaagagcctgaatcttttaaggtacaaatttcaaagacagcacaggtattcacaaagcatcccttctagtcactggctaaccgcatggctcaccctacccatttccgcagtttgtggcagtcattattgccaacactaaaaagagcctgctgggttttggaggtacctggagccctgagccccaaagtctcaggaagatcaattaactttaatacttagcttcctcatccacaaaataaagaaaattctttgtttgcagggttgaaatgagcattaaatgagatgattttggcaaagatcccagtaccatgcctggcacatgctgtgattctcagggaccagtccctcttctcccatcctcggtcattgctcttgagtttttgatcttccatatactgtcagagcaggaggttaactacagcagctctgagttttgtcccttcaaatgaaatatgtcccacatttatttcagcacattcaatgaccattataccaggagaaggcagtgtcgtatgcagctggaaatgagggcactgacttcacttcacaaatcaaaaggcataaagttagtctgaggctctcgtcaatgtgcaccttgtaaatctgcggccctgctatgagacactcattcctgcagagagggactgaaataaaatttagttcactttctgtagtagaaatgacagtttttctatgtaaaaatagcattccagtggattcaaagatgtgtcatatcattcaatgtgtttctggaaactctgttactgttaagaattctgaggaccacttgctgtagtaaaaatggcatttattctatgtaaacagagtaaatctataacaagacagatcattcagttgttgcacgtggaaaaaaaatctgccaaagtaacctatgtcgtgaaagcacttaatgtgttatccggcacatggcaggtgcttagtaagtgtgggtttccctttcatttccttttcctaaggagtgatccatggagtcatcttgatcttgaatccaagaatgtccctctaggaccatcatttgaatacagttggtaagaagaaaaataaattcatcatttatgagtaattgatttgctaaatgatcctctacttagtagatttacataagtgacatttacaaaatgaaaatatgccaaaactgaaaaaccatgacatacaaatttgatgagagaggcaaaaacaaagataatgataataaacatggaagaaaaaaagagatagatgcctgataggtcagatagagagatgccctagaggaccctataggccctcccaatcaggaatcacaactcattttctgaaactatgaaaataaaatctaggcttgtattctttcaatttaaggaagttcttcttgttctagatctttgtttggctcttccaaaatagtgatactggccagtcacatctgaaagtaggctgcttctgtcctggatgttgtcactaggtcagaaacaggggaaagaccctgacttctcggttcccctcttcccctgcctgtagtgtctggacgaggcggatcttttcattcacaaggatcttgtcatggatcctaagagaacaggagacacacacaggagaaaccaagggtggcgatgggctccataactcccagggagctgctggctagctgtcgtttcttcacaatgggagtcctattttcttgtcctggacaaaggcagtggggaggaacaatctcacacctctcagccgtccaaccaacccctgcagggcaaatgcattagttcccgctgttatcctgaggactgtttctctgcagagggacagaagagggagtgctcagagcacacagtgagccgggtccccaaccttcctcctctcctgcaactcacagtgcaactcagtgatggatccttcccataaataacagggcctaatgtgctcatgagaggggattgcttttagataacaaggatgtaatggaagcagcctcaaatgaagaaacttgcaaatgattaattatggatcaataaaagatgatccaattgattgtagagaaagtctgcagcatgacttcctggattcgctcaatgtatggtctttttaaaatgcttgctgtgatcatcctgtgttgatggatctacttcacagggagggacagtctaagtccccctttaagccttctgtgtctgcctttagcaacttaacacacaggcatcagaacacaggacattgcattagctgttattcctaccagacttcatgatgtcaataaaggaggccagtaaaggctgtcactatgcaacttacaaaaaggttttgcttttttgttctgtttcagtaagactggcttatttattgccgtgtattcctacttacttttctctgaataacaagattaatttaatgaaaagaaaacccaattccataccccagaaaatgatcctgaacatatcatcttattaaaaacagattttaaaaattaataaattaattgagaactggggcctctggtattccagtggaagatgcccgtcatcacccattttcgcttcactgatgggaatttccaagagcgaaaggtttgtctcatcatttcagtgtaaaaattagcgctttgacaatactttgcatgggctaaaagatgctgggaaagtttttgacaatttgaaaagatgtctatctgtttaaagttctctcagttctcagcaggtggagctaggagaatgattgtttttctcctaccaaaatgtgagaaaaaaaaaaacattccacacctatagaaattttaatcacagaaaatgagtgattctcaaaatgaaaccaataatagtgtcttctttagctagcaaatcttgcctctctattttgcttttaattttcaagaacaaccagtcacattagcctacactgccctccaaaaccccgtgtgagggatcccaccagactcgcactgcacctgccaaggttgagaggaagaggggcttgtcaccgccccccacctgattgaaagtagaatatatagcaggagaaccaggctgcacacgtactgtacaaatttggggggaaaatattgttttacacaatcacataatagatgctcatggttaaaaacaaacacaggaaaaaaaggagaggctttcttcaagtgtgtatttatttatcttctgatggaatattctttttgggcttttgaacccagcaatgccctcaggagcgaggggtgaggggcattttgctccccatgatgatggcatgtaggctcctggggcacaaggcaaaaccaccgtatgagttcccagctccactattcttcaaaacataaacaggccaaaccaggcaggagcctaatagcaggaacatattttgtattataaaaatacacagtagcatatacttaacaaatcttcttacgcagtgacccctctcctgcaggaaaagtaatcatggcattctagagtttgcctgcattcaaccaacataaaatcaaactcaaatgtgcctagatgtacatctaaagcctctgaaataattctaacagttgaaaaagatgaatgagataaacagaaggaattaacatacaacaattattcttcctttgttcaactcttcccatgaagtataatttcttttactattgtaattctcaaattcagcttaggcagctgagaatgtgtatcactgctctttaatgaagaaggtttaatattattcacattgactattatactctcctatatgcttagacacttcaactctaataacaccactaggtaacactaaaaggacaccaagctttacataaaacccaaggtcaaaaataattaaggggaaaaaagtcaactttttaagaaattctttggatggaattcttaaaaattaaaaatgacagtttttttttgcgcatgtgtgtaaagtaacagttaagtcaactctatttttaagtgaagatattattacatttgattattataggttggaaaaatgtcttcaggtagaggaataatcaattcaaaaaatgtcttccaactttacatttgtagaccattttacagttcaaggcaatttctcattccttatttcacttaagccagttaaaaaacccagttttacctgactcattgagatgtctgactcagatgtgatgtgtgtcaaaaggagtctgtgattactgagggagcactaaaattggcaaattaaaaatatatagttcaagaatatgttcaagatgaaacttgtgaggacttcattctaaggcttttgctttctgatgtgttacattctgaggtgttgcattctgacatgctgcattcttcctgatatgttgcatattctgacatgttgcattctttctgatgtgctgcattctgacatgttgcattctttctgatgtgttgcatattctggcatgttgcattctttctgatgtgctgcattctgacatgttgcattctttctgatgtgttgcattctgatgtgttgcattcttgctgatgtgttgcattctgatatgttgcattctttctgatgtgttgcattctgatgtgttgtattctttctggtgtgttgcattctgatgtgttgcattctttctgatatgttgcactctgatgtgttgcattctttctgatgtgttgcattctgatgtgttggattctttctgatgtgttgcattctttctgatgtgttgcattctgatgtgttgcattctttctgtgttgcattctgatgtgttgcattctttctgatatgttgcagtctgatgtgttgccctctgatatgttgcattctttcagatatgttgcattctgatgtgttgtattctttctggtgtgttgcattctgaagtgttgcattctttctgatatgttgcattctgatgtgttgcattctttcagatatgttgcattctgacgtgctgcattctttctgatatgttgcattctgatgtgttgcattctttttgatgtgttccattctgatgtgttgcattctttctgatatgttgcagtctgatgtgttgcattctgaagtgttgcattctttctgatgtgttgcattctgatatgttgcattctttctgatgtgttgcattctgatgtgttgcattctttctgatacatcacattctgatgtgttgcattctttctgatgtgttgccctccgatatgttgcattctttcagatatgtggcattctgatgtgttgtattctttctggtgtgttgcattctgaagtgttgcattctttctgatatattgcattctgatgtgttgtattctttctggtgtgttgcattctgaagtgttgcattctttcagatatgttgcattctgatgtgttgcattctttctggtgtgttgcattctgaagtgttgcattctttctgatatgttgcattctggcgtgttgcattctttcagatatgttgcattctgacgtgttgcattctttctgatgtgttgcattctgatgtgttgcattctttctgatatgttgcagcctgatgtgttgcattctgaagtgctgcattcgttctgatatcttgcagtctgatatgttgcattctgaagtgttgcattctttctgatatgttgcattctttctgatgtgttgcattctttctgttatgttgtattctgatgtgttgaatcctgatatgttgcactctgatgtgttgcattctgatatgttttcttgttgagtttaaaagatggagctgtatgcagggttacaggaataaggcacaaacaatggacccatccatgggtgtgaagcacatgtgcggccagaacccacctggtgggtcatgactgaaaaaacactgtgaactattgcctaggcccatctcatggttgatatctttcctgctactctgaactctctgtgactgtctataataactgtaggcatttctacacaaccaatagttttttggaagcaggctaagattttttacatgtatcattaaataaatttacttattttgaatttaacataaagcataaaagatttaaaagtaaaagtatgtattttgagtaggtatttccttacattgtgtacaccgtgtatgcattttgaatgtttgtttatctaataaaagttgtaaaggcttttggaaatataaaactgaatgatcccccacatttctgaagaaatgtgaatggcaaattataggatgaatgggatggattacaagtcagaaattaaactctataaagataaacagagactgaagaagacagagaaatgcaattggaaatgaaggctaattaaacaaaagcactaaatatgtctaagcagcaagctacaattaacatggaagacaaattgtgagcacaactgcattgtgaatatacacacaccaaatataaatattatgttaataactgtgacgacttggtagaaaggtgtatgtttcagtaggtatagccattacatttactttttttggtatttttttttaacttttgttttagattcagaagtacatgtgcaggtttgttacacaggtaaactgcatgtcacgggggtttggtgtacagataatttcatcacccaagtactaagcctaatacccaacaggtactttttcttgttctatttttttttttttgagatggagtcttgctctgtcacccacgctggagtgtaatggtgcaatctcagcacgctggaacctccgcctcctgggttcaagcgattctcctgcctcagctccctgagtagctgggattacaggtgtgtgccaccatgcctggctaatttttgtatgtttagtacagacagggtttcaccatgttggccaggctggtcttaaactcctgacctcaggtgatccatccacctcagcctcctaaactaacaggtactttttctggtcctctccctcatcccaccctccatgctcaggtaggctccagtgtctgctgttcctgtctttgtgtcaatgtgttctcattgttcagcttgcatttcttcagaggttttttttttttgtgtgtgtgtgtgtgtggagataattcacttttatatttccgaaagcctttaaaacttttattagataaacaaacattcaagatgcatacagtgtacacgatgcaaagaaatacctactcaaaatatatactcttattttaaaagtgagaacatgcaacatttggttttctgttgctgtgttagtttgcttaggataatggccgtcacctccatccatgctgctgcaaaggccatgatctcattctttttaatcagccattacattaaagatgtcagagttttatggggctatttgagcttcagttagcatccagggttctttgcattgtctcgatgacctggtctcatgcaaacaatgtctggactcaccctcacttgttagcagtgagcagattgagtttgcctcaggagaattttctagggacaaatggagatctctaatgttgccctcatattccccctttggagcaacagcaccataatgagggcgtaggaacctctcagtaaagattgcctttctacttcagaaaatgctgctaacagaaaaaaacaaaaacaaaaagaaaaacggatttttatcaaattggtaatgaaacacttatttcatgctactgggtatatgaggtattattatcagaaagatatcaaacagttaaacttcacctctactagctacctaggaaaaatatgtccaaattttatctaatttaggacaatatggatttttaagtcttaaaactgatgggaaagtctatggaatctccttatatggaaaagtatgaaaataagccagaattaaaagaactgagtaagataatctcatgaaaccctttgcaggtttataatttaattttttattgttaaaatgcccatggtttatgaaccttaacttagaatcctcctgtaatagccctgttgaataaacaacacccgggtataatcatcttcagatacgaaaggcaactgcattcgcatttcttgggataacagccagaatactacaggtagtaaactttgggagtgattaccaaaccacctaggagataaaactcccttagcttccagctgatgccttattctcaagatttgtcatgacataattgcccagaatataagactcgaggtaattcactttgcttaactgaaacaaagcttgatcccaaagagagaaaattttcagtccttgccaagactgctgaccatttctttccaaaaatagtgacttggggtcagtggatcatttaatatccctgcttagtattgttgaaaattcccagggggtgaaaaaaaaaaaaaatatatatatatatgtatatatatatatatatatatatgtattccaaagtgaatgacacagaatgtgtaagtgcttatatttttaaactacaagtctgtctccaaaaaataactttcatcttttctcttctaataaatactttttaaatgacctctcttttattgaaaattcatttacacacacacacacacacacacacacacacacacacacacacacacatatttgctaatggaaaaaagaacacaacacaacaaagaagtgtatcataaggaaagtttccctaaagttcatctggatgtggttttacatcatccttccagccagtgaacacacagatgtgaagacatgtgcaagccatgtttgttaatttataaagtactgtacctcggttttcctgcaaattttaaagcaactgaaaatgaactgcagcttacattgctaacattttccagcccatacaaagtcataagataaccaaaaatcatgtttcaacccacggtattccatacaatgaatgctttcactccaggcctgcgaattaggctgacatcttccctagctgtaatatctccatcccaaaatacgttcattcaatatgttcatcaaacacagtgagaatttctgttttcatactgagattagtattgtgtggagccacctgtacaggattatgaaaggcagatcgcaaagtcttgtgatggtcaagaccctctctgatcagcagaggaccttggtactcaggcctggacttgtggaaactgaggggtaatacatttgtgttaagtgtgtggtaatttgttgagctgcggcaatagaaaatgaatacagtgactaatttccctaaacatttagaggaaatttcttggcataggtgagtttttaatgctaaaatttaaaacagttgcttttttcacttgatgttttacaaattccagtgaattgaataaatcttccaagccaatgctattgagtgggacctgagtgaataaggtatgtacactctgtactgaactgaatatttttcatagttttaccaagtttcatgtgtccctttcccatttgcctatatcacaatgatgacgcacctaacagaaataaatattaatagtctgaatgtggatatcaccactaataatttccttttaattaaacacatgcttacaaacacaatttccttagaaaaatattttctttttccaacacaagagaattttagggattataaacaagcaaaaaaaaaaaaaaaagcacatgccccctccagtgttagttgctgccttcctgttaggtgtcttctccagcctctgttccccttgtagagagaggctgaggagggtggatcacaaggtcaagagtttgagaccagtctggccaacatggtgaagggtacagttgacccttggatgacacaagtttgagctgtacacacaagtccccctcatgtggattttcttccacctctgccacccctgagacagcaagactaacctctccccttcttcctcctcagcctacccaacataaagacgataaggatgaagacctttatgatgatccacttccacttaatgaagagtaaatatattttctcttccctatgattttcttaacattttcctttctctagcttacttgaggatatttatataatacaaatagcatccacaataggtgttagtcgactattttcgtcatcagtaaggttttcaatgaagaatcaactattagttgttaagttttttggagagtcaaaagttgtacacagatttgcaactgtgcaggggctcagaacacctaacgcctgtgttgctcaaggatcaactgtatttttaaaagtgagactgtaaggccaggcatggtggctcacgcctgtaatcccagcacctcgggagactgaggagggtggatcacgaggtcaggaattcgagaccagtctggccaacatggtgaaactccatctctactaaaaatacaaaaattagctgggtgtgatggagggcgcctgtagtcccagctactcgggaggctgaggcaggagaattgcttgaacccgggaggcagaggttgtggtgagccgagattgctccattgtactccagcctgggcaacagagcgagactctgtctcagaaaaaacaaaaaaaaaagtgagactataaaaatctattttgcatccttcttcttaaaaaattcttccttttacagaaaataagtcccaatcaatacctgttacctgctatgtataacacagcacatccttccctggaatcacgggaagaaaacaaatgtctctgttcattcattctttcactcattcatccattcattcatttgctgttcactgaagtctaagcctgtacaatgtgtaagggacgtacaaaacaccacctgtcaaagaactcaaaatctcatggcaaggctgatgttcacatgaattatcaaagagaaagggcttttgaataacacagacttctgtggagatcctccctgtcctgcttgcagctgtttatactcttggcaaattatgtaacctctctgtactcctttaattgtctgtaaaatgtagaaaatcatatctacctttctgagcagcagtaaaggtgagaagagatcatacatgtagaacacatacttaggactgcagttgttcagtggctaatcggttgtggaagccctggataaacactgtgacaacacatgtctgagaagagggagttgcaaccagcctgccattcactccctccccttaccgggggccatccccagggcaaagaaaaggaggctgagacctggtctaatctccttgtcaaccaggattgttggaaggaagaagccttgtctctgaagtccttagcaggacatccagctaggaataatctgttagtaaacagaacccaagattcctaagacatgacttcccagagaatgtcatgtaagatatacaactttctgggggtacaaattagaaatgttttatattttgaatgttccctgctgtctgagaaaccccaagacctcatctattctgggtcagaagggtaagcccaaagtgggaagaaaggtcctgttctcacagctccaaatttgtgttttgtctgaggcttcaatggcctgagtctctgacatggtttagtgaagctcaacactgtgtaaagtctctggtttgtgtgagtcggagctcacagtctgaccaagcatagctcagcgttctgctcatgcaggaaggagtacagtgaaggggaggcggaggcattcacaggcagaagaaagagatgcagagatgagagagggcatggtgcaatcaggcaatgggatgtgtcaattctgcaagagcatactggaaatgggagacaaaggcccgagtgcaggtgcacaggaagaggaggggctgacggcgaggtccaggcacacctggtgaagtcatctggccttcaccaggaaggcaaggggaatccacttaaaggggaatgaactaaatcaggggactgcttgaccagaacaatgtcccttaagagggaattaggatggagcgatgaggacagcgggcgcccttgcgaaggctgaggttcacatgagggacagaacatgaatgaagagcagaggcagggatggagaggggagaacaatctgaaaactatctaaggatatataagactttaaagcagctttaacaagggaaataaagtgtggatagaaataagtacgaaaagaattataagatctaatatgatcacatttttgagcttcacattatggcattcaatgctgtatgtgcctgaaatatattaactcaataaaaccttacactaaccctttgaagtaggctctgttattattcccatttgaaaactgtggtaagtgaagcccagcaagattacagagctactgagtggcagggccttggactgtaaagcaaaactgcctagaacaaagccatgaccataccagatgactccataaacatggcaggaaacacagaagccagggcgagatggcactcaaaaagcaatcgctgttcagggcaggatgcgatttctggctagttacataaggctgatcaagaagaagtgggctcaagtttcagaacactctgcattacatccagcgtatcacatattacatcccgtttaactcactgaaccactattaccatttggaaagattctatctgcattcctccaaaataatagtttggaaaagttcatttaacgagccctcctatttgaacctggcctgccttgattgataagacttcaatatcaaatgtagcagccttgagttttgactctcgttcaaaagtgagtttcaaaagtagatttttcttaaaaatgcagatgatttcctcttctttattttactatttttctataaatagtaaaatatactttcatttctctgaaaagtaacaccaaagcttcacctataagaataacttattactgaattggtgtctttctcaggaatttaatccaggggaaaacacctttgtcactcgaaggtgtattcaagccaacagacgattctagcatcggatgtcaggaaggaccaggggtgctcccgtcatctttaaaatcttccattctgccctccatcttctgaattcacatttcatgtcctctatcttagtggtgagaggcttagcttttataaacgtgaaaagtcactgaaatggacctaatattgaaggaaaggaagtaacatgacattattgtctttaaggtaacatagcaaagggtaaaatgtgtccctgagtaatcaaagcacaggcaccacaggctccccgtgccaccagctcccacacacgcagatgctggagaggcatggctttgaacctggtaccaagtagggtagatgacaactagtgtgtgtggtcaccaggtgtagaggctgctccccgaaaccctgggtgcagtcaccactgatgggttctacatccgtcttagacctgcaggtgggggtccagcatcaggctggctggagcctgcaaccacctacttaaatcagaagtcaaatgtgagtgctggccacagtgatattctattgaccataaatctgcctgaggttcatcctgctgaggcctacacaggcatctacactagagcatctaataatttcactaagtgttagagaactgacaaaaaataataataaggcaaactgtgggaaacaggtatacagtttttgtgagataagatgatgtgggttactggtcaaagcccctactggaaataagaagatattgatatgccaggatcctcttaacgtgatttaagctaactcatttgacttcactggatccgtattttctccattgtatattaagtggagaggggcagggcggccaggtgcagtggctcacacctgtaatcccagcacttggggaggccaaggtgggaggatcacttgaggtcaggagttcaagaccagtctggccaacatggcaagatcccatctctaccaaaaacataaaaattcaccaggtatggtggcgtatgcatgtaatcccagctaccagggtggctgaggtgggagaatcgctggaacctgggagatggaggttgcggtgagctgaaattgcaccactgcactccagcctgggcgacagcgagactatgcctaaaaataaataaattaattaaattaaaacaagcaggagatgcactattttaagtgccttttattcataaaatttaaaaaacgtatttgcaatataaaaactgaagaggtgtaatagctattcatacttacgtgtataatcggattagtcgggaagagtcggcatgaggtgtttaaattctctcaccatcaacatttcctttcactacttttccaaactgctacacttgaaagatgtttgccaaataaaccgtatttcagcaattttctttttcttccttttttcctttcctttctctctgtacctctgtctttttttaactcaaagacacatgtaacaattttttttcttgtttcttttcttttttttgagacggagtcttgctctgtcctgcaggctggagtgcagtggcacgatttctactcactccaacctccacctcccgggttcaagcgattttcctacctcagcctcctgagtagctgagattacaggtgcacaccaccacgcccagctagtttttgtatttttagtaaagacagggtttctccatgttggcccggctggtctcgaactcctgacctcaggtgatctgcccagctcgtcctcccaaagtgctgggattacaggcctgagccactgcgcccggccaacacatgtaactattaatgaggacttcagatcagcctgagttaaccaatgttatcaaacgagttgatacaatttctgcccaaagcgacttgacatttcaattaaattgtgcagccttttcaaaggaaaagatatactttcctttaagtgcttttgaaatattaaaaatagcacctggatgcccatgattaattttatggatcctcgaatgggagctatgcatacgcactttgtccctttgaacctaaggatgttattgtcctcgtctatatcaactacgtacacaaaggttcacccctgcatttcctgaggcctggaccccatttccacagctcgttactgctacttgccctacctgtttcactgggactgcagggctcttttacctgtgacttcctgcctcagtttaccccaggcagtctctaatcacttgatccagacagatatgcctctgggccagcactgctcccatgtaggtggcctccctcggtcccacgtcctccagtgataattctgaatgggccgtttgcaacattgatgaacacatttagaaaccggatgtggtagttgaatcaagttcgggttttacaactgtaatgaacggctgacacttgggcaggcagctttgccatagacaggtgtggaacaggcagtgagcccaagctttgcagctgattcagtgcagagtctcacatcaagacctttgacttgttggtcattaaggaatttatcagggcaataacttttagtaaaacagtgaagaagaaagtctatcaaaaaacaaacagtaggcccgtgtggtggagaaaccacaagctaggtttcattctgatccaaggaacaggtgggctttccctatgcacaaaattgtctcactccctggactgaattgatggtccagaggctttaaaatactcacggacctagcttaagaataactgggtaaatttacaaataattgacaactactctgtaagggccagaattaacccaaagaaacacatttgctagtgtgtccacagccatacatttgcattcttaattcagcctattctcctgggttcacgctgagtccaacttttgacatcgtccttgcagtcattcatgcaactctgtctatctactctaaaaagctgaagggcatctgtcagctaatgagacaatttctccaacagctggtactcatgtgagggtaattccgtggatttattcagtggtcatgccatctaatagtttctccgaggacctgattcaaagccctcaaaattgaagtgtgggaacagaagcataagagtaacaagacactcgatgagacaaatctcagaggcagggcaaggaaactgaacggagttgacaccaaggccgaaggtggctgccttgtaccggacggggaatccgaggatcaaagtatcttgtggcaaagtctccctggggatagtgtctgtgtgccctagagcatcacatcagggggcctctgtctttccagaaaggcagtcaggttcttcatccttcagacacgatccccactgacctgggagaaatgcttgtcccagtatcagccccatggatgaggcctgggcagtaaacacaccacgagggttcaaactggtctggggtgatcctctgttgaatacacaagcagattgattgcattcaacctctttgtctcgggaaggacgttacttacaccatcccaaattaataagaactatcctccaaataactcccatgtgatatggtttggctgtgtccccacccaaatctcattgtgaattgtaataatccccacatgttaagggcgggcccagtggagataattgaatcatgggggtggtttcccccatactgttctcatggtagtgaataagtctcatgagatctgatgggatttatttatttatttatttatttatttatttatttatttattttgagacggagtcttgctcttgtcaccgaggctggagtgcagtggcacgatcttggcacgctgcaacctccgcctccgaggctcaagtgattctcctgcctcagcctcctgagtacccgggattacaggcgtgcaccaccattcccagctaatttttgtatttttagtagagacgggattttaccatgttggccaggctggtctcgaactcctgacctcaggtgattcacccatctcagcctcccaaagtgctgggattacaggcatgagccactgcgcccagccctgatggttttgggagttcccctgcacaagctctctcttgccagctgtcatgtaagatgcgtcttgcttcccctttgctttctgccatgattgtgaggcttctccagccatgtggaacggtgagtcaattaaacctctttcctttataaataagggaaaatcctgggtatgtctttattagcagcatgagaacagactaatacactggaatatttgagaatcttcatgacgctttcaaaacaatattttagtcatctgccctgaaacacctccagggtcttcccatgtgcattgtggaaagcaagaactggttgctctccttgatgaagctctcacatatgcaaggacatttcaggctcaaagtgtccacagttattgccttgctcatccccttcacttttttgaagagaaaacagaagtgataaagaaagctagtttttatggagcctctctaatcacgccaggcattttcacaagttagctcattggattctcacagccgcgcagagtagcaccatggcattttgacagaggaggaggcaaaacctggaccacacagctggtgaatgcccacagaggggtggcgccccctcatctgacaaccaggcccaccctttctctgaaggccgcagaggttgagagagaagagtccaggtttccaatccaacctggttcctggtctttcctgcttctgatagagaatatttagtttaagattctctaagctatatctgaagactgtaatactctaagaagcatcagtccctcattgccttcataataaaacttgttttccctaagtttcaacttattggctgaaatgaatttttttttccccacagattagatttggaatgaatattttacaatgtggaaattattcttcctgctgttctgccctggcactcccaacctctccttgcctgtctatactggtttctaccttttttttttttttttttttttttttgagacggagtctctctgtcgcccaggctggagtgcagtggtgcaatctcggctcactgcaagctccgcctcccgggttcatgccattctcctgcctcagcctcccgagcagctgggactacaggcgcccgccaccacatccagcttttttatttatttatttatttatttatttatttattttgtatttttagtagagatggggtttcaccacgttagccagaatggtctcgatctcctgaccttgtgatccgcctgcctcggcctcccaaagtgctgggattacaggcacgagccactgcgcctggacttggtttctatcttatctcacaatgatcaccaccctccaacccaacatataattcacgtccatccctttgtcctccgcccccacttgcgtaagtccctgcaaggccgggagtgagctctccctagaacactgccgggcacaccgtgagccccgaggaaggcctcactctgataacttacaacaaagggaacttttgaggggaagtacatgcatatgttaatgagtatagccaacagtatcattctatattgtatacattctgggcaccaattctgacaaaataaatcatcgagaagtctggtcaattctgttggaggcttgccctatggtccctgaatataattcttacgtgcctgtgcttttcagggctgcgtctttgctagaaacaagtgattaccaaactgttccacggagccctggggtttttctcgtgacttcgggggcctctgagagggacagctagggcagcacctgattcatccacttgggtatatgtggtttctgcttcagagatcatagaagagtagagctcatggatttttatatgtatgaatatgttttttaaaagccaactataaatattcactctataactcagcttaacaaaagtctattttgctaattatttactgtttttttttcttttttttttcaaactgggtataatgctcctcaaattgggaaactttcagatctccaaattacagtttccaaataaccatacatgcagcacagatgtgaacagtgggtccaaaataagcaccttagattaagccacacgatgaatcacttcgctttcaaaaacaataaaagccagaggccatgttgcacatggcacagagaagcaacagagtccatttctgtaataagcatgacccctcactgaatgcttgctatgggagatgtgtgcctcctgctgtgcgggctggttcccaacaggccatgaaccagcaccggttgctccatggcccagggcttcgagatccctgccctagagactatattaatgaattaggaataacattaacattcctaataataggagatgatgactaggaggtggattaacatggtcaaggacccaaagctggaagatcccccaggcagcattgactcgtggtctattccttcactgtactgacgctcctagcttcgagaatgatgcatgggcaggcctgttccattaacgttttgtcaagtgactaaatgaaacataagttcaagaaggcaccttccaccagagatgctggctcagagattaacaaaagccacatcaacggcatttggaatcactcatttaattacggtgatagatgccagcagcagctcccattattaccacatgcttaccattgccagacactactcgaagcactcaattgtcttaaatggctctaaaaggtcaatattagcgttatgtccacttggtagatgagaaagcagaggtacagaaaagctttaaaatgtgcctatgttttcacagctgtaagcaatggagcaggattggaacgtaggcagttttactctagagctcagatttttaatgctgagctctgattttaaaacttacaggactatgaagccattacctataatatagaagttacattagatctggttcttcccttaaaagagtttctgatctaatcagggaggcatgaaataataacataaaataaaataagatattactctgtacatgtttccagagggggccctcagtgtggacaggtgaagtcagggcaggcttcctggaggtggtggccttgccagagccttggagtagttctgagcaaggctgaaagcatttcctaacaggggaacccaggagtcatggggtcatggaaagggagtcttttcagaggatgctgacctaaccaggcgacaaggagagatgcaagaagaaaagcaggatacaaagtgttcagctttatggccaagagcaagcatgccacacctgcgaccaggggcaccaagcaacctggggtcaggatgcatgctttctcttgctgttggaacgtgaatatcttgtaggcagtttgtatactctccagttgacccctaaggacagcaaacaattaacaccctatttaaaggctagaatataggaaaaggaggatctgaaatccagtagactttccagataagagaggagaccctgggaaggcagacggcaaggggaggattccaggtgggatcaaagctgagcaaatgtctgatgtctctaacagcccgactggaagaacaagtgaccagtattttccagtcaattagacacaaagcatgattgttgcagcctggtgtgtattcaattaggactgtaatatgatgaagctaagaacagattattttgcagactttcttgtgtctgtgcctgagagcttgctcagaggatcctgggtgacagctctctgtgggggcctgtggccaggaggggagacgaggcctcatcgtggcattttcagggctgaaatgccaaaacaaaatgctcacattcgttaggaacctcctatgatccaggcaggtttgtgggtacagcacaagtctctccatgaattaggcaaaattatcccccttgcactaatgaaataagggcctgggtgcccgagtaatttcctaaagtgaaactaagatgtaaatacaagtctctctgttgccaaaacccaggaccttttcattgtgccacactgccttctgtgtgtgctctgatgaagagcttttgtaggtgttcttcaagatggaactgaaaattgagtaagacttcccagagacccagctgtgggggactatccgcagatggagaccctgggctaaagaggcaaactcttattttataagtaggggctaattggctgggtctaagtccagaatccccccagctgttatccccaagcctaatgctcaaacagacacatacaaaaaaagacaagtcaacaagaacggagaaaaatcaacccagaaaacaaaaaaagctgtaatagttgggtaaggtacatttatctatttttttatatatatatatttatatatatatatatacacacacacattatacacacacatacatagatatatacacatatatgtatatatgtatatatctatatagatatatatgtatatctatagatatatctatataggtatatgtatatatgtatatatagatatatatgtctatatctagattctagatatgcacatatatatctatatagatatatatgtctatatctagaatctagatatgcacagacatatatatctatgtatatgtctatatatgtatatatctatatgtatgtatctatatatctacgtatatatctatatctatatatctatgtatgtatgtataatactgaagctgtcatgtgactaccctagcaaagatcttatccacaaatataattataattataaatgcccaattatctgttgagatatcagctcatgatcatcttattgtagaaacgttttcgattgattttcaagcattcataagcattggctgagagactgcggtctgtaaagcactggcagaatacaaatgcttgttgagtcaacgggcatttattgagcatgtattatgtgctggtctttgaagactgaaaatttaaaaaacaaggcccctgtcctataatataacctattgcttggaatggagttttaaaaaccatgccaaggagaaattgtcatcaatgcctccttcctctctttggagatttctgtgacagggtaatgaaaattataatcactttagatatcaacctacttgcctaaagagaaactaaagagaaattgtcctgaattcacataaaccaaggtaatggaagtgatatgtttctcttttttttttttctcatcagaaaactgattattttaaacaaattgcagagaaagagagagagaggatgagatgaaggaaatgtattgacttcagagttgactcatgaactgtcatagtataagaaactgcatgaaattctgtagtgcagccaaatattaattgaaacaattaactgtagaaaacacgtgggcacgacaatattagcagtgcataatcatttgtagttaagaggtccttaccggattactgcagaaaagctctggagttctaattacttgtggaagtcccacaaggttactgcaaaacatggtaattagacggttgtaatataaggtgttagcaggggattgaggatttgctctaagcaccttggtgttttcgtggctatttactgagcagagtaccagaatttaatggaatttggtagaattctccaatgactcctatgagcacgtagttaacaaacgtatcttaatgtgagttccatggttttcttgaaagtgatgaacatcgccatctttaactactataaggagaaaatataacctaaatgaggtggattatgtggatttatttttgggatttattgctcttgtctttcggtggcatttgagtcaggtgtattacacagctttgagatcttggcttcactaggcataacccagcattagaaaggaagtagcttggtgcttctctgcaactccagctcagacttctgtgtgacagtccttttttacaacagaattgggacatcgctgcatacgtttttctcagctttgaggatgcttctacaacccatgcatgcacaatgaaagaaatattatacatttagtgatgggcacaatgtacttattcaaaaatgtcagtaaatataaaagatttatcaggtgagtgaaggagacacgtcttttttttttctttctcctttttgctgatcccgaatcactctcttacgttttttttttgtctgtgtaccacaaatgtgtacctaaaaatgaaactcagactataaactgccctaagctcccagagtagaaagcatgaaactaatctaaagaaaatattggcagaactcccacccgcgctttgattttggctcagaaaatcacctcctccttctatagggtctggttcgcctccgacagcagaatcaggggcagattccatcagtccatggaaatggggttcctggaagtaacactggctttctcatcttggtccaggcaaggggcacttgtcgggtcactgacaaaggcattcattaagagtcagttattttctgcaggtgcctttagtgagacaacagtgagaaggggcacttgggaagacgcggggagtgtatggagagccataccccactgcttctttggggttccaaacctctaagagaatttcccttatgctttagctgttgagaattgaaagtctcctttcaaacatttaagcagagcaagaggggatagctgctttgctacagttacctgttagtcaaaagcttaaaggagaaattcccttgcctgtcatgtgtattccacaacgcatgaaaagaccagacaaagcgaaacaaaacaaaccaacccgccgccagggggcagctgggaaacatttcgaagggctgggagagatggaaggttggcaaaaccaaggggagggggtccttgtacttggtgaacagatgactctctatagtaaggattcagggccgggaggcgggcaagcaggtacgcctaagcttcttgtgttgctaaccccctccgggtctaccccagttagcaatgtctactgggacctagaggggcgcagcttcgcctatttctctgacaagactgtaacatcttggaagggagaagctgtgtcacatctatctttgtaagccacagagcaacgagcaaagtgctgagtacatatatatacatgcatgcatatatgtgcatatgtacgcacatacacatgtatgtgtataatcgtataccttacatataaatctataattatgcatcatctgtatctgttaagttatacatcattttagtgcttttatggaggaaggaaagtaatttgcaggatcaatttctatgcagaagtgattcctggtacagattttaatgcattaaattttcacaaagtcttcaactccagcaatttaagttttatcaagggccctgggttttgctggctctcttcacctgtacctcttatcattaagagggaaaaagaaaaatatcctttcctgtagccccatggtacactgcaaacccctctgagaagctgtaatgagctggggaagctgtagtggggaggaggggaaaggctctgtaatccctcggcctcggggctgacatggggcacatcaggactcccctggcgaggctctgtcacttgacaaacttgtgtagttggagccataaattctccttgtactccgttgctccccacccacattcaccctgcacctctcacctacaagaagtgacagtcagagtactttaaaaaacaacaaaaactcaacagattttatcctttgtaaaagcctaccatttccacatttgtctaaaatgctgattttatagtcctctgtgtttgcattgcgtttgttatgagaactaactcctttatataggaatagcccagttgaagcaataccacttgactggatattttcaattcataggatattaatggatatagcacacataggacatatatatatatatatatatacacacacacacacacacacacacatatataaattagtacaaaattgttttgcctcctaacttgcaaggcctgtaaacccattcttttttctttttacatagatatgttgagatttttacatcttggcaaaatataggctgtaatttaattgacttagcaacactaccaaataaaacacttattcccaagggaaatttctttccacactttctgctggaacttctaattgacatctatttctgaataattgttgaaactaatgtgttggaagggctggtgatctcaaatagctataaatgaggcatcatggcatgtttttttcttcctgacaaatccataagtgaataaatattttaagtcagtattggccaggtgtggtggctcatacttgtaatcccagcacttggggaggccgaggcgggtggatcacttgagatcaggaggttgagaccggcctgaccaacatggtgaaaacccgtctctactaaaagtacaaaagtagacaggcatggtggcacatgcctgtaatcccagctactagggaggctgaggcaggagaattgcttgaacccaggaggcagaggttgcagtgagccgagatcacaccactgcactccagcctgggcaacaagtgtgaaactcttgtctcaaaaaaaaaaaaaaaagtattaaaaattctgtccacggaattgatttaatagatgaatcaataagtctggtatgaccatcatagagcaagcagataaggctctaggtacaacaaatatataattgtattagtcatcgaaaaggaatgcaatatatttcactagtcagagaaatagcaatgtggaatagaaagaaaatatgtaaaaactgatggacttttatttgaaatttggttgaacattaactgtggttctccctaaatatcatatacattttctttcacttcattggtgatgagccattaatatcataaataatacatactggtagaatgagtaaaaaaaagttcagtagaaccaattaacaaacaatgtaaaacatgtagatttagaatacctgtcatttactcaggtctacctttttgcccaaatttcataattctcctatcttggtcaacatctacaaggacaagatgaataaatctctctctgtgtgtagaacatcgtctgtttggtttcctccaagtagaaagccaggaatgattcttccttcacatttcctatcaatcataattctatcagccagctgaatagcttggtacactcagcgcctatcaaatattaaagccttcccattcttgaaattcacataatagcttggtttgttatcttgcactaaatctgtactacattacacatttatgattacctgtaaatttcacactgatatttaagttgtaaaatatgttgatgcctttaaaagtgtgtgagaacataaaattacacaatcataaagtaagttaaaaattacggcagcataaatactaaagtccaaattcttgtcttacataatccaagtgataattgttgtgctcttactctgtggctgaggacactgtgacaagcatggagaattcagctgtgagccagattacacgatccctgccttctgggagatgataccaaataaactcaccaatgaataagtatcgcaaattattacgtggggtataaagaaaacaaagaggaagctgtgaccaggtaccaggcttatggtatgggacttttcaaagccaagccttgaaggatgagaaggagctatgcacacagcaggtgaaggagaaggggcagtgaactggctggagaagagcaggtgcaaaggccctgcacgggaaggtggttcagcatctgcaggattagcgaggaggcctgtacaactgccacagggcaggcaagggaaggagagatatgaaaggaacctgcggaacattatggagaatattatgaagaatttgtatttttcctaaggaatccgttttgggacagggaactgatttaatttacatttttgaaaaaccctctcaggaggctgaggtgggtggatcacgaggtcaagagatcgagaccatcctggccaacgtggtgaaaccctgtctctactaaaaatacaaaaactagctgggtgtgatagcacgtgcctgtagtcccagctactcgagaggctgaggcaggagaattgcttgaactcagggcagaggctgcagtgagccgagatcgcgccactgcactctagcctggtgacagagcgagactctgtctcaaacaaacaaaaaaacaaaacaaaacaaacaaaaaactcgctcaaggttgggtgcagcagctcatgccagtaatcccagcactttgggaggctgaggctggctaatgacctgagcccaaaagttcaagaccagctgaggcaatatggggaaaccccgtctgcataaaaatataacaattagctgggtgcattggtgcgcacctgtagtcccagatactcaggaggctgaggtgggaggactgctcaagcctggaaggtcaaggctgcagtgagctatgatcatgccactatattccagcctgggtaacacagcaagaccccgtctcaaacaaacaaacaaaaaacatgctggcttttgtgtcgcaaatggattgtagtatatccaagaaaggaagtagagagatcatttagtagacttttacgcaagttcagtaaacagatactagaggcttggactagagtggtggcccaaagacagagggtaatgaaaatattccaggtactttgggagcaggaatcaacagaaattggtgatgggttatcaggggcatcaggaagggagggacagagaatggcatcagtatgggcagtggtaacgcttgtgtgaggaacagtgtcagaggaacaggtgtaaagggtgtgtgggttatggtgcggttagaatcaagaccgacttggaaacaagctaagtttgagatgcctttgagaatccaagtggagttttcaaggagtcagtttaccatgaaattcagaagttctgcagagagttcaggagataagacataaatttagaagtcatgagtaggtaaatgatattaaagtaatgctgatgaagagttgcatgatagttgtctgggagtgagaagtctggttggggaggagaagctaataaaggagacagaaggagccaccaccgagggagaaggaacacagagagggcatggagatctggaagcccatagtaagcacgcagtgaggattagtgttactatcatttggcattaaattgtcttatccagtggaatatcccagtgggatggaggggaaaaaagccaggttggaaagagagaagaaggaatgggaggcaagtcagtggggacaacatatggcaaccactcttagaagcagtacgaagaaggataaaaaattctgcggagggggataagaggtttatgggtggacttttgtttgctgttcagttattgactggctgagcatgggagaggagagcatgtttgtaggatgtaggagatgaagcagggagggagggcccatgaaacctagagtgcagatgactcaagagccaaccccgagtgggggagcccaagcccaatgggggcgggggggctcggcttggagcaaggccaattctctcctggtaatgggaacacaagtgccagagaaggatgcaaatggcaaggaggttgagactgggttgtgaggcaatgagaaaggtcccttctgatagtttctactttatcattttacattttaaaaagatgtgtgcagtgcagccatggagtaagggagggagagcagaggagaggttaggaaaggtcagagggtaagctatgaagagctgcataggagcacgggaaatccagcagccagagaagaggaggacgatcccagacggtgcccagtgtgtatctgcggaggaatttaaagtaaaatgggtgagcccagttgtgtaattatctccagctctgcaaagtggacattcatgtggggttcagattggccactggaatggaggcaggatttctaggggagagaaagcctcaacagcttacagggaaggcctggcagacccaatgttgcatgacaaggaggaagagtaggcgggtgagacaaatgacctgaagctcacagcaggccatgctcaggaggaacgtgctgatctcaaagagaaaagtgtgggctgagaggacaccagcttgactccgagggcctaggagatgtggagagggaggggcaagcagaggaaggggtttccttgagagacgacctggttccggagaagttcctgcagcaaaaacacgcggggcatccagggaagtgcacgggccatggcggaggctgtccgaggggtggggacacgagggccatgaggtgggtgcttgtgggaggctgcggtgcgtgattagcagcaggtgagagtagagaagacagcggaattgaagacaactgggagctaagactggagggtccctgcggcctctcagagggatgggggctgagccctcccatggtcaggtcacaggccctgcaggtgctgggggccaactcacatcccttttcttccctctcccttagggtctcaccacttccgtgcaaagatgacaaatattgtgtaaacgaatattcaatatccctaacattcacaatattcctcatatctagctcacatactttagatcctcaaattcctattttaaacaaaaatgcaactgtcgtggtgccagatgatggcatttagcctctttagtgtgttacagaatcttttcctgagacacttaggaaagcacaaactttttcacccaaacaatgttgaagatggcagagcctggtttgagaatccccactcagggggagaaatagtcccagggtgccagtatccagagagctgacctaccagggaaagtgcttatgtttctttcaggataggcagtatggcaaacaaagtcccaaacacatcaatatgtcattgatcacttgacccaacttaaattttttattcctttgttcattgataacattgcatacccatagcgtgtgacagttttctcaggggctgaggatgcagccacagacaagcccagcttcttgccagtaggggaggtgcatgacagaaagcgttttgattctttttatcatccatactctctgcaatgattctcacagacaacgcactctcccaacatactgcacccacgtgacagtgggagcagcctccctacactatctccataactctgcttggtgacctctcagatgacagtaaacatcatcactcccagatagttctgaaattgtcatgttggaaagtacttgataactgttaacacaaaagggactcagtaatatcgaagggttatggatatatattcctattatgtgaaaaatacatatcttgcattcctagcagacagtagtaggttattgctggtactttcatatgttggggggaaaaacatgtacttaaaacagtgcctcgactacggcaagcagaattgaaattatgatgatgataatgatgaaaataacattactttcattatgaaacagtgcaaaatggatagtagacaaacactatccgtaattcaatgtggataattcaacgtgaagacactggaagtaaaacaatactttgaggatccagaacttcctcatttcacattctgttaatcagggttgacgtgtgctgttggctggctgtcttcatgtcagccagatcatcaagaatgtcttatcaagcaggtgagtgggaaacagactctcccctacaggccagcacaagtggctactgccctctgttgccaatagacagtgggcaataggtgttggaaaaaacgccaaggatattaaaatgtgagccttgaaaaaggactcatgagcaattgacaattagcaatcagctgggttgaaattgatcaatgagggattcaaagtaataaaaaataatgagtccgattaaaggcaaagcagcaaaaaaaagctagtagcttctacttagaacacatagttcatgaaaattactataactaaacattgtatttaagaacactttctcggccagacgcggtggctcatgcctgtaactccagcactttgggaggccaaggcaggcagattacttgatgtcaggagttcgagatcaccgtggccaaaacggtgaaaccctgtctctgctacgagtacaaaaatcagccaggcatggtcgtgcacacccgtaatcccagctatttggaaggctgaggagggagaatcgcttgaacctgggaggtggaggctgcagtgagctgagatcacaccactgcactccagccagggtgacagagtgaaaccttgtctcgaaaaaaaaaaaaaaaaaaaaaaaaaaaacactttctctcagcttttaatttttattgctgtttcccaaattattctttctttagaactgtttatcacatgacaagaccaaaagatttttctttccttttcttctttccttctctctctctctccccctacctcctcttttttctttcttgctgtctttatgtctttcttttttttaaatagagattcatggcctgtgtgggctagtgaaatacccactgggttaggggttgaaagatatggaggcaagtcccagcaacctcacttcaaactctgagtcataagataataacatgaacctagaatagctaagataactttgaaaaggaagaacaaagttaaaggataaatgcttcatgatttcaacactaaatgtaaatctacagaaatcaagacagtacgctattggcatacagatacccagatagatcagtgacacagagcgcagagaacagaaatagaccctccagtacatggccaactgactttcaacaaaggtgcaagatcagttcagtagcaaaaggatactctcttcagtggatgctgtttgaaaaaaataaataccaataatataaaagaaactttgattcctaacttgtatcatacacaaaagataattcaaaatagatcagatatcttaatataaaacataaagcttctagaagaaaacataggggaaaaccttcatgacattttgttaggcaaagatttcttaggtatgctacataaagcacaatccataaaagaacaagctggcaaattggatttaactgaaattaaaaacttctgctctttgaaagacactgttaagaaaatgaaataataagccacacacagagagaaaacatttgcaaatcatacatctgataaaatacttgcatgtagaatatataaagaattcttacatttttatagtaagaatgcaactcatattttaaaatatgagcaaccactgcactccagcctgaacgacagagactccgtgtcaccataaaaataataataaaatatgtgcaaaagattttaacaggcacttcaccaaagaaagtaagagaatggcaaataaacacataaaaagatagtcaggccaggcgcagtggcttatgcctgtaatcccagcactttgggaggctgaggtgggtggatcacctgaggtcaggtgttcaagaccagcctgaccaacatggcaaaatcccatctctactaaaaatacaaaaattagctgggcatggtggcgtgtgcctgtaatcccagctactcggggggctgaggcaagagaatcgcttgaacccgggatgcagaggttgcagtttgctgagatcgcaccattgcactccagcctgggcaatagagcaaaactccatctctctctctctctctctctctctctctctctctctctgtgtatatatatatacacacacacacacacacacacacacacacacacatctctctctctgtatatatatgtatatatatatacagttaaatatatatatatatatttaacatcattagtcattaggaaatgcaacataattccatagtgagacaccactacacacttaatggaatgtgaaaacttaaaagattgatgataccaagtgttgagtaggaactggagcaactagaactctcgtacattctgggtgggcatgtaaaatggaaatggtacaaccaccacggaaagtagtttggcagttccttaaaaagaaactctaaaatatgatttagtcaccccacttctaggtatttacacaagataaaaagaaacatatctacatgtacaaagacttgcataaaatttcatagatgcttgttggtaatgcctggcaactggaaacaagcccagcattcatcagcagtggaaaggataagcaaattgtggttgtatacataaaatatacacaattcagcagtagaaaggagtaaacttttcttatacacaacaatgataaatttcaaaataattttgctgtatcaaagaaatcctacaaaaagagagtacatactctacggtagcatttatatacaattctagaaaatgtaaacaaataaataattgcttggcagggacacatgggaggggtcaatggctatgttccttacattgattgttttactggcatatacgtgtgtaaaacttatcaaatggtacattttaaatatgggcctcttgtatgtcaataaagctgttaaaaacaatataaaccaacattagccatttaattaacacaggcccacttaaagatgatagatcaggaagtcaaagctcagagaaataaaaggactggcctgaagtcacaaagctgaagagacttgaaattcagtctcaggtctgtctgagtatacaacctgtctcttccgtcctataccacacaaacacatcttaacctcttttgttttgaaaatctctcatttcaggccgggcgcagtggctcatgcctgtaatcctagcactttgggaggccgaggcaggtggatcacgaggccaggagttcaagaccagcctggccaagatggtgaaaccccgtctctactaaaaatacacaaattagccaggcgtggtggtgggcacctgtagtcccagctactcaggaggctgaggcaggagaatagcttgaactccagaggcagaggttgcagtgagctgagattgcaccactgcattccagcctggcgacagagtgagactgtttaaaaaaaaaaaaaacaaaattaaaacaagagataatctctcatttcaaagacatcaaaattccttcaagttgtgtaatcaggatggcaagcattttaatgtatgagttcatggcacgcctgcatcttccccctcagtaactaggatctaggggcttcctaggtcagttggtagaatgcattggattggaaaggttggccagtcactgtaaatttaaaggtgtttttctgaatgcttcagaaagtaccaaaaagccattaaaaatgaaagactaatggaacaattatgtcccattttgacttgtaaaaaccaggattctttgtgtcttcagtatttctagtatttctaagatgttaatcattccaataaagctgaatggcatgacagattttcggcacctatcagagtggcagccatttccaacttcttttttattctatatactgtcaatgtcactaacatagattacatttcaattacctttttctattcactgactcacatacatttcacttaattgctagatccttccacgcagttttcccattgtctggcttccacaaccttatttctgtcacaggttgtacagccaatggtcaccacattgcagagtatatatctggtgtttcaagtgggttttagggttccccagatttagaaatatgtacacctgaacataaaactgggttcagttttctgaagtctgaccaatgagctgacatactgatagctcactgaggtaaaagaagctttgtgatacaactgaaggatgtttatactttcagtgaacgaggcatagcagcctaaatgcaaccgattgaaccacaaataatacttctcaatcaaatggccttttatctttcttgtctctaaatatacccttttaccacacagctcgttcttaaaaaaaaaaaaaatccggtggtcacaatgtcaattgctaactttattttctatttatatcgtccactttatgaatacccttttcctcaatttaattagttagtgtcactcacactttaactgggaacattgtaagactgagctgaatttgaaaacaatgccacgatgtcagactgagtcacatcaattttctaactgcccaccacagccacagcgcaactcaacgacacccacacgggtatctgcgtcctggaattggacttttacatttttattttaatgaaaatgatgtattacatataagtaaaacaacacctttaaagatggaaaagaccctttttttcaagcctcaatttcagttctagtgggacagccaggtgggagggggtccctggagaaactccaaccagcctgccctctgcagtggggaggagcctggcccctcctcctcctgtgtggaacccgagattcaggctgagcgccggaagccgtctagcagggactctggcctagcgagagtccctgtttcccccttttcttccttttcacctaataaaaccctgtcttacccaccctttaaattgtcttgcaagcctgaatttttgtggtcgtgggacacagaaccccgtccatggctgaactaaggaaaagtcctgcaacatcagaaccttcagttccgcataattaaagctcaatgcaaaagaatcatgagcataagtcctctaagagcataaataatcaagtgttgctgatgttccctaatatttgtgcgttttcagcctacacccgcacatatctaaactgttatcaatggcatgaatgagtcaagacttcagtgaggcagcacatatttcaatacaatgcaacttcgctggccacaatcaatagagtgtttttcactatgccatgctttgagtattcagcaatcacttcagaatggcagactgccgtaaaatagaggccaaatcctacccagagaaattttatggtttaaacagatgttctagagaattactgaaaattaatgtcccagtcctaaggtattatggccagttaataagtgacatggtgaaccattgtgttgcaacaaaacatagtaggtacttgccttgaataaatcaattctttattgtcatatttttgtgtctttctccagataagacgggctgctctttgaaagtaaaaagtacgtctttttgctttgtatttctatgactagcactgtggccgagctacggtgtgcagtggatggatggatggatgatggatgaatggatggatagacaaatgcatggatcaatatgtgcatgtatgcctttgtgccacatggtacaatgtaacaggagacctcggccaatggttgcaaatgctcacatgacaaatgacaatcatcagatttaccagatgcacaagttacagtcagaaataggtagtatctgataatatcaagatatataatgggacccaagaaatagattaaagactgactttataaaaatacagaactgtaagcatcagcatctgaccagcccaatctcctggcttccaagtaagaaaaccattctgaaatgttaaaggaaaggccaatcatacatagagagctagaagcagagctataatcagaaaacagaggtaccaacttcagtccaaggcttgtatcaccttaggaattctatcaagtacacactcatgaagtgacatttcctgaggaggttggcactgggaaaaacggaatcccaaggaagaacaagatttgaaggtttttcccaaaatggttataatttaagtggatttatcaagaacaatttgtatctggtaattaggtagtgattccagaatggaacaggacatgagcaccttggaggacaggacatttggcctagggaggtctgggttggtggaggacaggacatatctggagctacagagcgagagtgggcaggcagttcaggcattctccagttggcatagacgggacagaattcctacgggtgagggctgaaaaaacaacaggcacacatgaagtcgtgctctgggagttaatgagaggaatttaggtagccaagaaagaaaactaggctgatgtgaggcaacagtaagaaaaaatacgaagccacagtaggctggaccagaacactgttgtggtaaaaatggaatctcaattagcataagacagtgagcgaatggacagcagtgggagaacctgacaatgaggaattttgaggttcttgtagattcaggagtagaataaagtctgaatgctaatagtgaccaagttagaacagaaagcaaaccaaaaagacagatgcactagaaacgtgattgaaaaagacccagaagggttaagtcagggtcttttaatgcagaagttactttcaagctattaatgaacaaattaaagactacttgatgtcaggctgtgcaatggacatttctatgacggtggaaatactctatgcctgaactaatattgtatccactgaacgtatttacattgttttgtaatcatgagaaactgaaatttaatttcatataatctatataaatttagatttaaataactacaaaaaccggtggccacatgtgaagtttggcacacaatgcattcagtgtactatagagctatgaaatgcctaaggaaaaggaataaaattctacacataataagttttatactgttatattcttgatgcataattgctacattctaggccaccattgctctcaaatatactggcaccaagaaattctattgccattttcaagttgaagttttcaattatctttcctttcctgtaacattctagaaaggatctgagacaattatacaaatgtataccaataacatttaagtagacaaaaaatggagagaacatgaaatactgagagactactgaggacaaaagataaagagagcatatagaaataaaacccagaatagatgacagtttcttaagataagtcctgaccttcctagtggcctaaggagagtcaacattgtactctgtaaccgttgtattacctatagcatagaaaacttatgtgtcattcaggagaactaatatttttcctggactgaagtttgaatcacgcaaatgtctttgaatcgcacaaatcatttgcccaaatcgtgcgactctctgtaagcttgtgagccgtgagttggcacgttcctgccggaattggagaagcaaaggctgaaagaagcaggcagattgacaggtgatgtagatgcatggagacaaagaaggggtctttggaccaatggttctgttgcccccgagacccacccctgtccctgggaaacaggagacacccccatccttgatagtaaccccctcctctcttcttatattagctttagttggttctgttcctgtcaaccagatgagccttagtgcagaggggaacatcttgcaggagttgacgaagagcggagcagtgttagtgggtgatttcctcagcgaccacgttgtaagaggagattgtgcatctgtttctgtctctgtttcttgcactgcccgttgctgtgagttgagagtttaaggctgaggcacattcagcaagggtcatttacagaacttcaacagcacactcaccagcccctttcccccccacaacgtgcaaagtgcaatatcacccatattaaattgattgaaagttaaatttttgtcatggattccatgataccactcacgagcatttgtgagctacaagctgaagacctacccgtcctgagctgaatcgagaaacctaagcattaccttcaacgcctgcctgcccttcctccacacgaggcccatcacgagtcccactgaatttggtctttcacctctcctcttgcccctttgcaaccattttcctccctccagcaggagtattcttttaaaaatgcagatctgatcatgccacttctcttatatgaagcttccagcatctgacttccaggactgcatcctccagggtgggcttgctgggccctgcccatttgctggtctctttcactctcctccagccactctggtctctccatgctacagacatgctttgctctctcctgtctcaaggttttacctcaagttgttcctttcttcccctgtcctgcctcacttcctccgtttcttccatctcttatctaatctgtaattatatagctgcatggtttttcataaatatctgaaacccccactgaattgcaagctccttgaggggaagaagcttatctattctgcaaaccgttgcttctccctgtgacgcagagcctgcagtgtagtagatactgcctataaaatggacaggatgcttggatttgctttatctgacattttaaggacacactttataaattgtagaggcctatgcaaccgtctttgtttttacttagaggatacaaattatatcattcaacaggatgccacagttccatatatttctcaaaatgtgaccagatgcaccatttttaatgaaaattaagctctacttccaagttaagggaaaattattttaagctattgatacaagttttaagaattcagtaatttaattgtgcatttctatgtgaaataaaaacaggaaacttattagggtgttttctgtaatatgaataattaatatttgcaatttagaaatctatctccctacaatgtagctgtagtctcagaaggaaagtgtattaaaacaatagctaaatgctttcaattcaaagtacttggtattaaatccctcaggcatcaaaatagctctgtagtcttttctagaatagtatgccaagcagtcttaaacacatattttattggcatcagaaaagcaactgcaaatgttttctcttgtattcaaactcctttaaaaaaaagattccattgctgagctctgacaaatatgcctcctactaccacaccaggttcctttgcaaacacacaattcacaattaaaagcaattttgtaaaatgccttggagtggttaaatatgtaattgggtaattttctgaaatgcttattacttacttcagcctcatttcagtctcactggtaaacagtatattcctgttaagtgttattatccccaaaaacgcttccataatcttcagtgttcctttaacattcctataaacacatcatatattacttggggacgtggatcatgaaacacagaagctacccgtgccagtcccttatttaaatggcaaagtggtcttccttgtctctgaacccgggttttctaaatcattcgcatagtggaaaatgaacaataggacttttaaacctccttatgatttagattatatcttagctggttgcaaatctcattatcagctttacagcttgatttatttttatttttggatcagaaggaagaatggcaaaattacagcctagacgtttgctttggaaaataaagtttgaagttagctgttgttgatttatacccagtatgctatacttagcatgagtgtacagttaagcatactttataggtaattactccttctattgatatgatgatagctacagaagctgtgtacaaccgagaacaacacccaattcttgaaacagtaccttctaaagtggtatattaggcaaataaagtgtgatgatggtggtggtatttcatccaacaagagatattagataaataaattgtgatgatgatggtggcatttcatccaacaagaggtcttactccctctgaaaccaacatcttttactacttgcttagttatatatgaacaataaaaactcaccaagatcactgattttgttgaaatgaagagaaagtaaacagtctctaactgaaacgagcatgttcaaattaaaatagggagtaacaaatcaaaaacaaaataaaacaaaatgctttgaattgtttttgaaggcaaagtgtcccaaatacttttacttctatgctctattattttaggtcctacttttctacaccataacacagtattttaatattaataaactagtttccctctatgttaataacagagatcaattaaaatttggtctttgtcattttgcagttaggttattttaactcacaatacaacatgtacagttcttttattctacaaaaatatatagtattaagaaaccaaaaccattttaatcaaaatttctgctatgacttgaagactacagaagcccctatttttgcctgttgttcccttgataaagtattgatatggaagtctcaattactaaaacagaaaaaacttatgcctgctgtcattgaccacatttttttttttttagacagagtctcgatctgtcaccaggctggagtgcagtggctcaatcttggctcactgcaacctccacctcccgggttcaagtaattcttctgcctcagcctcctgagtagctgggactacaggtgcacgccaccatgcccagctaatttttctgtattttcagtagagacggggtttcaccatgttggccaggatggtctcgatttcttgaccttgtgatcctcccaccttttttgttgtaaaataatccttgatatgctttatggacaacccctccccacggttccacagaacacagtttgataaacatcaatctaaaggtactgcagagaggctgagatgctagtgtgtcttgcagagccattaggaggcactgtctccacgtactgatttgattgtattttttcatgctgagtctgaccaatttcatggattcagtaaatagtaagacttggtttaggggccagcagacaaggatcataacatctttgaggtggaagaagtcctagacatgaaagaggttttgtgaataaaaggtggagagggaaaatgaactttacagtcaggcagacctatgtttacatttagcttctgagagccttagtttcctcatctgcagaaggagattattagtatcaaccacagagaatcactgtgaggcttatatatggtaatgtacgcaaaaggcctgccctagtatccagtagctagaaagtaacgtgaccaaaataaccaggttaagttggggtagagtcaggattagcctcacgacttatagttcagtactatttctaccatagtgatctaatttgaagaacaagttagctaatgagtgcatcttgctgtaggtccaaaaacaacctccaagacaaactcagcatttcccttacaacaatcagcatgggccgggcacggtggctcatgcctgtaatcccagcactttgggaggctgaggcgggcggatcactaggtcaggagatcgagaccatcctggctaacacggtgaaacgccatctctactaaaaatacaaaaacaaaattagtcgggtgtggtggcgggcgcctgtagtcccagctactcaggaggctgaagcaggagaatggcgtgagcccgggaggcggagcttgcagtgagccaagatcaggccactgcactcccgcctgggcgacagagcaaaactccttctcaaaaaaaaaaaaacaaaaaccaatcagcatggcagaaaaaagaacgctccgaagcaaagctgcaagcattaactattgtacttctgatgcccatctaaagacacacaggaaatttgcttagaaattataacacggtggagaagtaaacagttagaagtcactctcaactgaggctgtttaggtatttgtaactatgttaccttaaaggttactgttctaataataaagttgtcctgtcctggctgggggtggggggctgggggtgtggggatgggagtgcagggaggtaggggtcttccggacactgcatcaggggaggtagcagcccctcactcaggtgtgactaggctgggataacatggatactgtggtatccctagagtatccatgttatctggctttagtgatggcattcctgaaaatgaaatgtgtatctgaaatgtgctttctgttaagatgtatcaaaaatttatgttttcctgaattttaaaactgactggtttagaaaaatgaatggatgacttcattttttctactttgttcaaatctagtctaattaagttttttttttttctgcagcgtaagacatgagttatgtcagaaacaagaggttctgatatttgaaatgactaaacacgaagggggctcccaagggaagttagggtattccttctgaaagtccttcaagacagggttgatttttaagtgtttgggatggctcaaatgcatctgaaatagattaaaactgaaaatattagtgcatcacatatagtaggaaagtattattttgtgaaagggttttcaattacatgcgtgtgtacattttatatgtttatagctcttgatgtaaaatgtatctctttccataggtagcagcaacgtaactttgaaatccactggcctagatcagtgctctccaaaattttggtggaaaacccctattagtaaaaataaagaattgattatgaataccaatactgattcaatgcaaatactgcttctattttatatacatttaaacacatggaaaacaaaagatagaaaaacaaaaaaaatttaaaggaggatataaaaagtaaatcaaacacagaaattataaagttttcttcctgtagcccaatgaaccatagtctggagtccacttcttttagtgtagctcccaattccattagaataccgtgaccccaatttcaaactacatatctgtttaatatcatacttgatttcagtccacaagcacataaatgagttttattcattactcatctgcagcctattcagaatacaaaattttctggaaaggacttagaagttatactaacaacccagttaaagcagcctaccaatgctatcagtgagaagagaaaaataatacagagtggtagcctcagtaatgccgctatttatactcctacatatacctctttctgaaaaagattagtttagaaaatctggttttgtgcaatagatctaatataagaattttataaagaactatcaataactttccaagttatttgttttcacaagcacgtatttatggaacgttttacatttcttataatgttaatccctgattcaaaggaattaattattcctatatcaaagtattaatgtagaaaatgtcaaaaagaaaataagatttttacttttcaactatacaacttcaattaaacctacatcgcagcttcaggtttcccgtgtgagtcacgcgtttctagaatgcattctaaaactggtgcataggtttggtggtgactgggtaccaggtactgtgccagtcatttttatataccatctgatttatgacctctgagttcagaattctcttcattttaaaacgaggaaatcagctcgacatccagttgagtgggctggtcaatgaattggcaccatctgagtacagggtcctcactttgcccaaggttcctgaagcatgaacataaccaagcctactccttggaagctgggctcccagtacccctagaggaatatctttttgacagaggctgccagatgtccgcctaaattcctcttttctctggttcctaggcctctactcaagggtccattactgagactccctcgaaggtatatatagccaaatgactaaggcctagcttaaggatcttaggggtgtgtgctatttctgggctgggattatatgaaagatgcatgcctagtttataatttcattcccctctgccagctggatcttggatgtggggattaagcttgaccatggagatatggaccaggcccagtgggataataaaggcaaaagatacaaatgcccctcagaagataaccaccacccacctgaaacgcccaccccaggcaagaattatgctgcggttgtgtgtgagccactgattacattgttggctttactgtaactgttggcagtttagtccacaataactggacgcctcaggtcctgacaatccatcctgggagagccagggactgagacatgaccacaaatgctgtcctagccacctgcacccccaagaagatgcttgaatctttacatttacaaagcacaggaaagttaggaggatccatcctgaaacgtctgctagtgagtctagattttcaaatcagaaaattggcagaaagagccctgcattccccagggacactgcgttgaagctcaggaaaccagcccacatggagcatggggaagggcttttgggaaggctggaggacaaggcgtgtcttaggaacacccagtagcttaaccgcagggagcagaacttacatacagagggctcacgttcaataggccttttctgaacttgggggtgctgagtatttaaaaactatttcagaattgagaaactgattgttataggataaaatgtgtacccccaaattcatacattgaagttctaaccccagttcctcaggatgtgactctatttggcaatagagcctttatttatttatttatttatttattcatttatgagacagagtttcattctgtcacccaggctggagtgcaatggtgccgtctcagctcactgtaacctccgcttcccaggtgcaagtgattctcctgcctcagcctcccgagtagctgggattacaggcgtgcaccaccacgcccaactaatttttgtatttttagtaaagacgggatttcaccatgttggtcagtctggtcttgaactcctgacctcaggagatccacccgcctcagcctcccaaaatggtggcattacaggcgggagtcactgtgcctggccggcaacagggcctttaaagaggtaacatgaggctattggtgtagatcttcacccaatctgactggtgtccttagaagacgaggagatgaggacagaggcacagagggaaaatagaccacaggaggacacaggcaggacgatatctaccagccaaggagagaggcttcaggagaaatcaaccctgctgacaccttcatctcagacttccagcctccagaactgtgggaaaattaattcctgccgtttaagccacccgggctgcggtattttgtaatagaagcctgggcaaactgagacagtagttgatggccgggcgcagtggctcatgcctgtaatcccagcactttgggaggccgaggtgggcggattacgaggtcaggagatcgagaccatcctggctaacacggtgaaaccctgtctctactaaaaatataaaaaattagcctggcatcatggcgggcacctgtggtcccagctactcaggaggctgaggcaggagaatggtgtgaaattgggaggcagagcttgcagtgagccgagatcgcgccactgcgctccagcttgggcgacagaacaagactccacctcaaaaaaaaaaaaaaaataaaataaaataaaataaaataaaataaaagcactgctgtgcttgagccacaagaaagagctgtcacaggtagcagcttgggggagggatcaggagtgatgctgaggaagtaaataagattacttctttgaatgctgttcttattcctccttccttgtgtttcaccactgccttttgtacagtgttttcctctataaatatataattccaagactggtgatgtctagtaatggttcaaaaagcagaaaatataagaaatattattttttccaaacactcgagtagaatcagtgatggaacatgtgagatcacctggagggcattcagactttactgcaaataaataatacaattacttggtttgggtattagatatttatgttcatcttgacattagaatattaagccactcctcctcttgctaacttggtatgcattgaaaacatgaaattctctcagtctcctgctttggaaccaaacagtataaaccctcataaatatgtaaatcaacccctctaagcacattattaattatttcaaagatagtaggaggtcactagctcatagcaatttctatgcatgaagtctcagtaacacaagacatcgcacagggaggaagaataaagttttatcacagttaccgaatgtgtgtgtgtatgtgtgtgtgtgtttgtatgtaagtggccaaagcaacatacagtattgaatgcagcaccactaggctctgaatagacgcctgtgggtgatgatgatggcggtagtgatgaaggaacggaatctacagctagaacagtatttttttttgaacctgtctgcaccaggaataatatttttaaaatccaaagggattccagcctcagatacacttaaattgttcttgacccacatggccctgctttcttctggaataaagttctgactagttgcaaaaatccatagctcaggaagatatagcaggcatctcatttcctgtgacactgcagagatcacagactgtgttgctcaatgtgtctctaatgttgcatattgccgagcggctctctggctgctgtaagtcagcttcgtttaggtgattctcagcaatcgacatgttctgatataggccgtggggctcgctgaggtggaaccacccaaaacaccaaatctgaagcagttgaggacgttggatacaacactgacagatgatggaggatatttaacacaggcaatgaactctgctttttacaattcatcaaacaaatataagacgcactctcaccaaagtgcaataaactgatcttgtcatccaagcaattcttcccagtcactagtccagtttgcttttaaatctctgattgtaagcttaaaatttatctgatgaaaaagataataaactattttcacacccaataacacacatccctcaacccaatgaggaagacagccattatctagtgtaattaacaaaatatatataacaaaaataagaatgaaaaaaccttgaatggaataatttgcacatatattcagaggttcaggactaggagtattactggaatttagatggttctggagagggacatttggcaaaacctttcaagcactactagtttgaaagttaaaagcaggcaaaaacttgcattatttagggttgtatatataggtggtagtgctacaaagaaaagcagggaatgataattattaagatcagatagtagttatatctagacaggcagaggaagcggctatggaggagatcacacggaggcttctgggctgctggctcacattgtgtgatccaggtggtggttacagaggttttctataactatgcaaatctataactatacaagtgctataagcactcttgtgtatgcataatatggctcataataaatttaagaatacatcaaaccatttaaaatgatatatttaaaggtcaattagtattttattgactacgttagaatcctcccagcctcaggaggtgcccactctgatgacaatgcagaatgcatacattcaaaaattgtgccaactgctgacgaggcagggggaaagaattcaggccattctactatctgtttatctatctatcatctatctatctattatcaatcaatcaacccatccatccattcatctatccatttatctatctgcacatacacactacacaaacacacactaaaaagaagaagaaatcctaaagacagctgttttgagcaacttttgtagctaccttaagtactgacagacatctttccacatttctttgcataagtaataaatttatagctaaaaattgtttgtgtttgccctcataaaacaaaggtagaatgtgctttttaagagtttttggcagaaatgggtggaaaaaattatttttattctctctgctattcagaacattcccaccttatttttgctttctcaaatgttattttatctttaaacacttaataagatgcagaaaaagaagaagaagaaggggaaagaagtcagtttggagagtcgaaattcaaggaaagtaagaactgggcaaagttgtcttggcgttcctcccagagaggaagggagtgatgctgctggagctgtttcaaacggacggacggaatcacttcatctgtaatccagacacatgcatgcatcaggcaaacataaaattctgttgtcttctctgaagtagaattctataaaggcagcatttccaaggccaaaaagatgaccgaacagacagtgccctgttgatccagctagaatgagctctgcaacaccatcaattttgtcctacagctctttttctggtccttgtccgtgtaccagtcactccttataatgaagtcacttgattgagtgttgttcctgttgcaagcagggagaggaaagctgagaagccattcaataaatgttatgtttcgccctcctctccaccagcgttagagactgctgtgtgttgacagcccgtttgctttttctccttggcacagggccagatcctgtttcctcccccatcctttctactccctgagcacacacacacacacacacacacacacacacacacacacacacacacacacggcgtggctaggcagggccatgtggctgagttctggtacaaggaacgtggaaataagtgacatgctccatttgcaggcctgggatctaaacctgagtctccagtgtggtgtgctgcttgctcttcctccgccagctggccccatgaagaggatcgagctgagacacaggggctgctgtgggtgacagaaccagaagatggcaggattcgggtctgggtccctggataacggagtggagcagaggccccttggccaacccacactggaccatgacatgaagggaaatcaatcttgaccctgttcagccactgcgattccagtgttgctttggttagagaagttagactattaccctgactttacaccgcctcatgcatccaaatcaaaggaaaactgtcaaaattgctaaatcattcccaaaaataaaacaggaaggagtttaaactccgaagcttaggaagtttgatttaatttcaatcaatttggaggcagaaggaactttgaacttggactacaagcacatcaggagttagtttcaatgtggcttcaatcctggtgccaccattttcacagtggcaattataattatacaaggtccaggagctagaaagagaatggactgtctgtttcagcgaggcaggcaaacagacaggcagacacatggagattgcatgtggataggctctgggtagtttaacattttaaagcttataatacggattgccaaattgctttatggaaatatatgaatttatattcttacctcttttgaatgtgtgtccatcattttatattttatgctttaagttagcaattcttttttttttaagacagggtctcactcagtcactcaggctggagtgaaatggcacaatcatggctcactgcaacctcagcctcccaagctcaagcaatcctcccacctcagcttcccaagtagctgagactgtagatatgccccaacacactgacctaatttttaaattttttgtagaaaaggggtctccctgtgttgcaccaggctagcctcaaattcctaggcttaagtgattcacgtagccctcccaaagtgctaggattacaggcttaagccagggcacccagcctaagttagcaattccgtagcaactaattatgttgaatttttaatatgcgtgttggccatttgcatatattcttttgtaacgcatcttttaatatatttacctagttttccaatgtgttttaggagttatattaacatgattatttgtatttaggagagcaatgttcgaaaaccaaaaaatattccttcatattagattttatgttttgctccctaagtaggtgtctgcaacccaagtttcttgactccctaggcatcgagaatatctctgtatctaaacaggatcagaactgtctgtctcatgctgcactatgactgacaacaaccaagaagcataacggactatagttggtgagctgagataatagatggaaagggaattgcattctaagttaggtgaaaactagaattacatgaaaagtgacctgggagtacaacagtaaaaacaaaaaacaaaaggcaaaaacataaccgatggacttgaatggtactaatggtgaggctgatggcatttcatagggaaggtgggaaactacttcctcagcccctagagcaacagaaaaatctgtgctaccagggcttataaaggacaagaagtaagtgcattttgcatagtagccatcattctacagtagcactctcaacaaatcaacctaaatacatgaagctccaccaagttgggtgagtgctactcagttttaaaaggagatgcagagggtgcttcatcatttcaaaacaattccgagcatagactactagtaatagctggcagcaaacctttcaggataattaaaaagattttaccaaagcccatacctttaggtaagagtttgtcagaggttctggaaataggctgttttggctatgtttgtcaatcttattttcaacttcatcaaaatgtactgaaaaactcatgctagctagcaagtcaaatcactagagattacatagacatgggcagagggagtatttttgcatttatgaatgctacagactcccattgaaaatgccttcttgcttacagactgcccaccccagagtagttcttaaatatttaaacgtgggaactttaacaaaccatgatgcctaacctaaaaggttaccatttaattggtctgaggcatggccttggcattgggatctttaaaaacttccatgtaactgaaaagcatatctggggttgaagaccacagcctagggagaggcagggcagcagagaagcaggagtacggagctctggagccaatcgtatctgggttaaactctcagctttcctcctcctaactctgtgatcctggttgcttaatgatatcgagcctttacttcttcctctgtacaaataagaataataatttctaccttatagttgttttaaatatgaaatagtgctaataaattagaaatgttcttttcttgaccttcttcccatagaactttcaaaggtatgatagtttaactgttgaggcaggcttatctattcacacagtgattaggaacgcaggcgctagagccataactctctggctttgtacaccagcatgtgcaatttaatgaacttctgaggttccattccttcatttataaaaatgagaagaataacaacatccatcctaatagggttttctggagattcaatggaggtttatgagtaagcactaagaatggcaccatatttatagtaagcgctcattaatcattactcgtttttgaattttagggaaataaaatttcatatcctacccttagaaagtataacacaatatctggtcaaagaatgagttcacactaggagagcagggtttctacctggatggtattttaagccagttttaattattcaccatcataattttgtcaatgaaaaagattggttcattgttgcctggccataccttgaagaatgtataaggtgtttagcttaagaagtttgaaagagacacaaaaaactagacgatggaaacagaaaagaacatcttattacacacatcttgatagcaagaggtattagatatttatctagaaatgaatatatacagacactgttaagacgtttggtgcatgagaccagtgtaatttggaaaatggtttgctaactctacggatattctcatatatatatattatatatatgagaatatatatataatatatatatacacaatatataagagatattttatatacatatatatctatatatgtatatatagatatatatgtatatgtatatatgtatatatgtatatgtatatatgatatatgtatatatgtatatatgtgtatatatgtatatgtatacgtatatatgtatatatgtgtatatatgtatatgtatacgtatatatgtatatatatgtatacatatatatgtgtatatatatgtatgtatatctagttaacagtcccaggggtttaaaaattattattatggtcttataacatctgtattcaaattctattacatgatttcctaggctaaggagacactaaataatgaatttgggggaaaggaccatttgtatgggctaggggcagggtggagaggaggtgagggctatagctgcatttatggaaaagcacagaagatcctggaacagtgccatgcatgggacatttgcttcttccacaggttgagtggtgactatgccaccccagcaggaggagtcattccaatttgtggtgatcaaagtcctttggaccacaccaagatagaaatacaaccaccaaacaaattcaaagaacatatttaccaataaatctaccccatttgcagcttcattcacactcctaagttcaggaaaatcaaggaatggattggagctatggattccagtaccagattaatccatcttttatgattagatagaaactttatcattgaaaggaaccgatggctttagggataaaatgtcctttgattgcataaataaatcttgctttaattttcttggaggaattacaatccaaaaatagccagtagtccccacgggggctcaaaacaattcgcacaggcattttaagctgggatggtggagaggttaatggaccactcttcagagaaatcagcaagggccactcccaagattccatacgtcaaagacaacactggggtctgactctggaggtccagccattttatacaattagaattgctgaggaggtcagccaagaacctccagagaaacattccacagcaccaggagtgcacgatcagcaacgtgcccaaagtgcccatcgtgttgtcaggggctgtgctgcatctgaccacagacaggatcaggcatggactctgaagccttcccgtagcagtccagcttccataaagctgtgctttcaatacattatttgtttctttacagaattaactgtcatttctgttttccatacgtattattaatatatgttatttatttatttattttttgagactgagtcttgctctgtcgcccaggctggagtgcaatgatctcggctcactgcaacctccacctctctggttcaagtgattctcctgcctcagcctcccgagtagctgggactacaggcacctgccaccacgcctggctaatttttgtattttcactggacacggggtttcaccacgttggccaggctggtctcgaactgctgacctcaggtgattcgcccaccttggcctcccaaagtgctgggattataggcatgagccactgcgcctagccaacatatgttatttataagattcatagacattgatataacctttagctccaccacagaagaaagctgtgccctgggagtaatatgggttccatcagctcttgttcctgataatctaccattttgatttatagtttgataagctttgatcctattctttcctttcctttcttttcttttttttctctttttcttttcttttcttttttttttttttttttttttgagatggagtctcgctctgtcactcagtctggagtgcagtggtgtgatcgtggctcactgcaacttccatcacctgggttcaagcgattctcctgtctcagcctccccagtagctgggattataggcatgtgccaccacacctagctaatttttgtatttttagtagagacagggtttcatcatgttggcctggctggtctcatgcctagcctcaagtgatctgcctacctcgtcctaccaaagtgttgggattacaggcgtgagtcactgtgcccagactataaactttgattttctatttctattttgttatcattttattttatgtgtcttgttctatgctccacgaatcaaggcaaagccaaataaaccaagaagagagatcaccagatagatgggtaattggctgatttatgcattgaattataggaaatcccaatcccaacctacaatgaaagaatgtccaaatgcatgtttctctgtaaatatacacatacatgcagacatagacacaaacacaatatgtatatgtttactggagtgcatgcttaaatcacaaccaaaataacaaaagccagtgtacattgcgtgcctactgtcttcagcatgtaccctaaaggtacttcataaggcattattttaatgtgtccacataaaatgatgctaatgcattatccccattttacctaagatgaaatcaagtcacactaaggtgaagaaccttgccctgtattatgtatatagtaagattcagagccagcatttgaactaggcttttctgaggtgccgtatataaaccaggatttgtgaaaaatggttcactggtttatgggggtaatattaggacttacacaggtattatgcaaaaaatatgaaaagaattgacctccacaaagacttaatgtacagaatgatatgtgtaccatctcataccctagcctgtatattggatggtcatatgtcatgtattgcaaaggggttatcccaagggaacagggagtcccacaaccaccactggagagtggagccctctcttgtcagtcacctttcagcagaaggtcatctgtgcttggctaaaagaataatgaataacttatctcattttaattaaattaaccctattaaaacagataggtgacttaaaaataatccttcaaagaaactattaattaaagatagaagtaataatctaaacatgaggaaaatgagaaaacggcaacactgacgatgtcggtacatacgtgaacatcaatgtgattataaaataggctccgagacagaagctaacgagagtagggagccattatatttagcaagacatttaaaaactaagcaagtaataaacaaaatgagtgtctctgttgagcaaatattaaagaaaatccagtttgttcttgacaaaataaaatctatgacatctgaaagtttctctttgcataatatagggaaacattgtaattggatatacagtttttaaaaaggctgaaataacacatgctaaacaatcttgtgacaaaccgaactatattttctcatgagtgagtacttacggagatacatactaaaacatggctgaagctatgaagaaacagggatggaaccgaaccatgccatgtggaagactgactacacagttgaatggcagtacagttgtttctagcctgtctcagcttctggttactagttcattttttaaaatagcaaaacacacaaatatgtaactttagcacttgtagttattaaacattaaggaaaagaggtgccagggaatataagttctcaatagcaactggtattttaaaaaataaaagcaaatttctatgagtattatatttaagtaaccagtgatgaggtggccacattcacaaaaaatgtgtagaaggattccaaagaaactttgcaacgcaacatctttccatccattcatccctgcctcactccctattaaaaccaagaagttgaacccaagagtgcataagattctgaggatggcattggcatactgaatttaaaaataaaagtctaaaaggtgtttaaaacacaattaatatttagtagaatccatataatgcattttaacaacatagagcttgaccacgcaaaattcttttcaaggaggttgttagttatctcgtggcaaagaaccaccgaaattaaagttaatttacgcacattctttacaagtgacccaactttgctaatcttttctgtatctacaaggggctgtcaacagtgtgctatacagaaaatatttttgaaaataatatatgtaacctgtccctgaaagaaaaggtgatgttttcaacatgactgagaaaaagaaacaccaaaggatcctaaacacatgaaaagatgctcaactttgtttaaaattaaaaagaaacatacagccaactacatagaataacatttctcaaatatataattagaaacaaagcaaaagccttgcggctcccctgttggggaggaagtggagagcctgatactgcactttgcaattgctgatgggcatggaaagcgcaccactactgggagagaaatttggaaacagtaaaataaatacacattttccctttggtgcagtaacccctcttctagggagcagatcccagtaatactctgacaacaatatgaaaatacgggtgcacacaagtctattagttgtagcaatatttacagtaaaaaaatgaaaacttagtgtttgccagtaaggaaaaagtaagctatacctacacaaaggaattcaataatgctatatatttttatatgtaagaaaatatctatatcggactagggagtgatctttaaaatataataggtactatagagtgaaaaaagcaaggtaaagaaaaatgtgtataatctactttctacttaagaaggtgacacatctataccatttttgatatcatctatagtatgtttacctatttttaaaataggtgattgtttttaataaacgtttacctttgggagagaaaaggaatattatttacctttatttatttattatttacctttgggagagaaagagaacgtagataaagggtgtatttctttgaatatagcatgttttgtagcttttgctttggaataatggaaatattttacatattatgaaaacacaataaatttaaaagcaatgaaaggccaggtgcagtggctcatgcctgtaatcccagcaccttgggaggctgaggtgggcggatcacctgaggtcaggagttagagaccagcctggttaacatggcgaaaccccatctctactaaaaatacaaaaattagcagggcatggtggcatgcacctgtagtcccagctacttgggaggctgaggcaggagaatcacttgaacccgggaggccaaggttgcagtgagccgagatcatgccactgcactccagcctcggcgacagagcaagactccatctcaaaaaaataaattaattaattaaaaaatttaaaaaaaagcaatgagaaatacatattcaattgatgacataactatacattaacttatatgagtttatatccctataaggatataccctaatgacaaaacaaactgcaaaaatcttaacattgttttcaataatcacacttaggtgatggtgtcgatactgtaatactgatactgttgtgggtgcattccaaagtaaggcaaatgagtaattttgttggtatcactcagtaacagaatttttgccaagggtgaaagaaacaacagttgtaatattggtgacttttcaatgaaaatttggtaacactggatttgaactgaaaatgttagtataactaatattgcatttgtacttaaaaaaaaaaaagtctcctagcttattccactaggcctagaaacagtaaccaacatggtgacaatgagcattccaagcaccaagacttttaaatactatttcctacgaaagggagccagaggtcctgagaaaaatggctgcttgcaggtcattcggcgagaattacaagaaaggtcgagagcaccttggtacactgcaaatcctgactaatgggtgcaggaaggttcactgtagtatttttccttacttttgtatgtttgaaatcgtctaaaataaaaagatacacattaaaagaaaatgggttcaaaatgaactgataactaaaaagatagagtgtgaagggaagacttgaaaatgtgtgtttagaaatgtttctattgtttgtggctttgtgaaggcagaaggcttaccaaaacaaaattgtcacattaaaagcattacagagttttccaatctgtaaataataaacttcactagattttggatgcttttgttaaaaagaaaggcacaataactttcaacaagttttccttaacaatatgttaacatatattatgtgaatcttagttttaaaaatcattgcattattggtagatatgcttaaaagtgagtatcataatttacaaagtcaacaaagaaattaatttattccatttggatctttttatcatttggaggtatatttttcagctataattgacattaaaactaaatcttgaaataaattgaacttaaaacctcaccattgagtcaaggtatcccatagtttcaaattaagttttgaagaattaatgaaacatatttagtcacattgcagtcatttatacatagagagagataggaacttttacttcactccaggtacataaattacctcaaactagattaatgacctaaatacaagaggtaagctattggtagaaaatatggaagcaaatcatcatgatctcagatatggcaatgaagtcttttgtttgacacaaaaagtattagcaacaacaacaaaaacagataaattgcatttcatcaaaactagaaacttttgttcaccaaaggacgttatgaagaaagtgaaaagacaacctatagaatgggagaaatatgtgcatatcctatatctggtaaggatccagtatccagaatatataaagaactcttacaactcaacaacaaaaacataactcaatttaaaaatgagcaaagaaaggacttgaaccgacattcttataaggaagagatatgaattaagataatcaacatcacagtcattagagaaatgaaaatcaaatccacaataagacaccacttcacacttactaggatgactagttagaaacagtaacaagtgacgacaagaatgtggagagagagaaacctgggacattgctacactgctggtggcaatataaaacggtacagcagctgtggaacacagtgggcagttctcctaaaggttaaacttcgaattctgcttctcggtatatatccaaggtaaatgaaagcaaatgttcatacagaaacttatatatgaatgtttacaacggcattattcataatagccaaaaagacggaaacaacacaaatgcccatcagcagatgaatggacacacaaattgtggggtatccacacagtggaatattattcagccacaaagaggaaagaaatattcatacacgctacaacttgaataaacctcaaatacactatgctaagtgaaataaggcagacacgaaaggtcacctattgtacgatttcttttataggaaatacctacaataggcaaatccatagagaaagaaagtgattggtggtggccagggctaggacagggggtcacaggcagtgattagctgggtaggaggtgttcagaaagttttgaagccaggcagaggtagtggttgtgcaacattgtgaatgcacaaaatgccactgaattgtacacttgtaaatggttaattggttacatgaatttcacttccattaaaatgtatatatgtaataacagtatagtacaagtaaagggtgctttgtaatgtgaaaagataaaatattaagtagttcaggtttatctcattctgctttctttttcacatatgttattttatatatattgggtatgtgttcaacattttgagtgatagaggtatacgatttaaaaattaggtaatactgctctagttccacggtaacaaatctagaacatggagagtgactctaacccacagaaaaacttagtataccttggctgaataatattgacaaacttattctcaatgcctttatgcaaataatgcattttccagttcaacacaattccttcattccccagaacttttatcttttgcgatccaaacattaatgtttcatatccagcaatgatcaaatttaaattcttctgctagggtttacgtatatctaagccagttttacatcaataattgttcttctgttcttcattagcattagagatggagagaaaacatgctagacttacccacacaaggcagggagtagccaagttgagggtcgtgaacaaactgccgatcattgagtcttgtcacacagtataagtggaaacagtctaagcaaatcacgtggcgggagttgcactggaaaaccaggacggggctcctgcagagagaaaggaagatgtttcctctagtacctgtcagtgtggaaaggcagcacgtgctttagaccaatttctgtaatcctggagggttgtgtagactgtgctctgtgcaaagaccggagctgctaagcattaagctcatgtataccaacacaacatcttaaaaattggaggcactcaatgaactacatagaaaactgattctcctaattttacattttttatgttaacacatttatcaatcttttgattaaacctgagctaaaatataatctctttctggaagtcttccctgactcagaattcccaattaacctatcaaatcatcccatctgcttgtatatatttctattgatccgttattacaccacagtattcatatcttctcctttctcatagactgtgatctcctggaaagtagttcctatgtttattttgctattcccatagtaccaggcattgtaaagttttaaatgaatgttttaaaaatttaaatctttaaaacattttaaatatttttttcctccaaagtattttaagggaatcaaaaaaatttaggacttgtatatagtgatttactagtaatcccataaacataattagagaaaattcaacagtgaaataacagattttcaaaattctgctatcccacttattttaaagcaatatgtaatacaaaacaaagaaaataaaattccttggtaatttaattataactatgttataacaatagaatctgaatttccccactatcaaaagaaaaattactattgcatcaaagtaaaaacgttaaacattttctcacattttattggcaaataaaaaagtagaatttagggataaaaggttatccaacagggattcttctactgcaagattttgtctattgtgccatctcgaaaccatccaaatattcagtttctcagagtatggttatgggattactaattaatcaatatatataaatcctaattttttttatccctttaaaatactctgtagaaaaaaaaatcttaaaagccatgtatttttactggaaaacgaaccacacaagtttatgtcaaacaggagacaagctcaatacatgaatttgaaatcagccccaaggcgattttaatagtaagaaagttattggagtctatttagataagcctatttcctatgtaattgtaacaaaatacaaaataaacatgttcattttatacccaatctttaacgcctataagagctcttcaaaagccctttttctagagaaatgaataatactaataatataaaagataatttcttaacacctaaaagattttcaaaattctgttatcccacttacttcaaagcaatatgtaatacaaacaaagaaaatacaattccttggtattttaatgccatggatgtgtaagtaatcggtcaacttaatctgagcaagggcgcacctaaaggtgcggcttctcctttcccctcttggaacctatccaagtccttcataatgctttcctatttctaaccaaacagtcactcgcatacacatgctcaagcacacacatacttttttcactttgcgaccctatgaagctgctgtattctacctttttctctcacagctgttatgtgaaaaatattctccatcttgctttcagcaacatggtagactaaaacctttatagacctcccaatctgctactaattcatggagaaaatattagaacatttatgaaaatgtgcctgtatataacaaagttaaaaagaaagcttagaggccaggcgtggtggctcacgcctgtaatcccagcactttgggaggctgaggcaggcggatcacgaggtcaggagatggagatcatcctggctaacacagcgaaagcccgtctctaccaaaaatacaaaaaattagcccggcgtggtggcgggcgcctgtaatcccagctactcaggaggctgaggcaggtgaatggcatgaacgcgggagcttgcagtgagccgagatcgcaccactgcactccagcctgggctacagagtgaggctctgcctcaaaaacaaacaaacaaaaaagcttagaaatgaccctgtagaggaaacataaagaaaacttacagagcctaaatggtcagcccacgaactcccgccacagtggcccagaaagccatggctgcgtggtatgcggccatcagtgtagcttctgcaggcttttccattcctgttagaagagttctctctcacatggatggacaacagcacacttctatagttgtctccttcagttttaatatgatcccaaatgactcataccatctagacaacacatggaacatcaattgtcctactctattaatgacatcctgctatttggagaacattaacaagaaacaagcactacgttggcggccatggtgtgaaatcaaccctgtgcagtgacaggagccattagggacattagggaaagtttagaggtccaagtcttggggcctggaagtgcacaccttccaatataaatagtccatcttacccatcctgcaactggcagtgaagcatagacagctgcagatgcggtgggtccagagttttggttcccacagagtgaagtgtatcttcctagggacacaggaagagtcctactgaaaactaagctacagctgcaccaggccacctcaacctccttgaactgaggatgtctaccttgaataaaaaataggagaaattggcaccaggtaacagtgggttaccagagagtgagcagtgaagggactagcattggaagtgaagacagagactcatgtaactcccttgaagaaacgccactgcccagacgcaggtgtggaatgcaaccggggaagctggaatgttgtgtgtgtttctgcatgtcctcttcggaaaagaaagaaatttacaagttacagggagtcaaaaatgataaatgagtcattcaggaattctgattgtctattactatacatacacagtcaacttggatatatacctatatacagatatagataaatgatagatacagatatcaatatatgaatgtatgtgctaagatacacagatgaagatatagaaaagtatatatgctgcctttatacacacacacgcacatacacagataatgttataaagacggtgtatatgtgcatttcacatagaattatcagtcacctggaattcttgatacagctgtgagctaagattgctcctctcctattaagatattccttgtagttttggaaagttaggtgaggaataaacatgacaccaataaaaagttattagattaatcacctaaggaaaggagtaaaaatcttttcatggctagaaggtctacatcattaacttcctaaatgctaaatcaaagaggaggggaaagctagtgtttatgggcacctacttcgggttaggtggcttgctaggaacttcgcagacttcctttcatttcatcctcgtaaaataaactgcccctcccctaccgtccatcctgttctctccgcacctccgtcccctccagctgggaaggtccttgcgtagcctaggattcttctagttcctgtacacctagatgcatgctctttgccatctagtctcacggtaatactcaccttcatattcaaagccaaatcacaaattcctaggtccagttcaagactaaagatctccaaggaactttctctggagcctaacacctcactgcctcttccctttttctttacctttcttcaatagttatttaaaaagttcatctgtaatgtacttcaatactggcctgacttttgtttaaagtgtttcatatactccttccttagctatcaacattaaatgaaaagtcatgaaattgtagagaccctacttgcttaaccctttcatgacccatgcctcatcaaatacaatgctgagcacctgatcgttttgtaatcaagagttattgattattctagtggataaatgaatgggtcactatttttgtagtttctcatacttttataatttctctgctctcatttacatgttgttcactaaatttcttattgaacatctactttgactaaagtaggcacttagtaaatgcatgtggactacagcacccagtgagtggataaataccttatagttatacttggcttacacaatcacagggcgtagttgagagacataagattaccatggaacaagtattacaaggaagtatctgtaatccccaaactctgggagcccgaaagttaggaaaagagaattattgagtcaggatggatccattagggaacttgaattgaatttaaagaaacgggaggattgatgtttggtcactggaaagaaatgttgtttctaagcaggaaggaatcacagacatgcaagtatgcttggaacagaagagaaatcaggtgggctgatcaaaaagatgtatcaggaaaatggtgggggacaagatgaaaagagttgagaacagaggagattctggccagggatcagggttgactctaggagacacacctagcataaggcctctagactgtgggattcactgaaggtttctgctatggtctgaatgtttgtgttccccaaaattcgtatgttaaaatccttatctccaaaatgatggtgttagaacacggggtctttaggaagtgaatggtgtgagagaagagccctcatgaataaaatgagtgcccttttaaagagaccccggaaagctcccacacacgttccaccatatgaggacacagtgagaagccaccgtctatgaaccaggaagtggggatctcaccagacactggatctgccagtgctttgatctaggacttcccagtctccggaaccgtgagaaataaattcctgttgtttataagccaccagtttatgggattttgttatagcagccagaatgtactaagagagtttttaaacatgggaagggaatgatgttttagtaagtttagctccgacagaagtatggagggaaagctggaagtagtgagaactacttgaggtcattttgataatttagacatgagttactaagaactggactatgatgtgcaaatggctctgggagtggaaatgagaagaagaacgggtgacatttcagagcaggacccgccaggacttatcctctcatgggtcttttgttcctcctgacattcctgtgtgccctttgctctaattatctacatataaatgttaattgatcgatccagagatgatttcaccccaatgggccaggttaaagagcggtaaattaaaggttaagtaaagttctcaattatatataaaaagacttataaatgctttccttgacaatgccaaagagttatttgtaaccaatgatttctctgttttgataaaaagcgaccctttgtttgcagaatatttaagcacaattgaaggagtttgagttacaaataatgtggcaagtcattcacatacattaaaaaagtagaatatggttacacagtgttccaaatatttaaattcttgtaaagttagtattctagcatctacaaaaatagcatgcgagtttttatgtttatctagaaaaatgtgcaatttactctgctgtccaccttgtttgttctctctcatttgccctccttcacacactctctggcaaaatctgtctgtttctctttctctccatttgcctgattctttcccatgtgtacatcttcatttatactcattaagagagaggctgtggatgaaatgtgacatatatcgaaagcaatgtgccagatatttcaagctatgcaaagatgaggaagcaaatctaagctctcaaggacatataaatccagtagagtgggcaggagagggaaacaaatacttactatacaggacagaatattttaagtcatgttagagagataggatatattgccacgctcacgctctggggtaagcagccttcaagatgttctccagtgagctccacctcctctgtagttcctctccacattgaatggattgactcacatgcaataggaaaagtgcagaaacggcaatgtgtgacttccaagagtaggtcagaaaagacaccgcagcctctgtctgtgctcttacagatcacttgctctgaggaaagcgagcagccatgttgggaggacactcaagcagtactatggtgaagtccatgtagcaagaaactggggccttctaacaacagctggcatctacttggcagccagttggcaagccctaggatgactgaagccctggctgatattttgactataactgcatgagataccctgagcaagaactatccagctaacttgctcccaaattcctgacctgctgaaactgtgagaggcaatgtttattattttcttcagccactaagttatgggatactttgttattcagcaatatctaactaattcaggttcagaggaggaggaggtcatatataggttgaagaccagaaaagaattcatgaatgtaggggcatttgaaaaacggtcaggattccagtgcataaagatgcagacaacacctgaggtcaagagaaaagaatggagctgtgaaagcacagagcaggaaaagagaatgctcagttatcaagagtggctggtttcttcattctccccagtggaaagcaaagttattacatatgtatgaagagcagcagcatctgaaatgcaatgaaaagcagcacaagttaaaataaaaatattacgtgcaaaatccttgaggaaataaaaactaaatttcctcacttgagggagagagtcttgcaatttagctaacacttgacccttgaaaattcacacattgtttccactgttcttagtttgtgcaatagtaacacagaagtcatgccccagttagcaatctttcaaagctctctgcaaactccacacatggagaactatgactcctgggcatttaacacagtatttgattagataaaagtaattaaaagaggaaagctacaccattaaaaaacatgaatttatcttcttaacgactgtcactttaagccccttttagttagagatggcttataaacaagaaataaatgactgaaatctcagagaccaaatgcattttaatttgatctatatttggcaaaattacatactaattgccaaagtgcacgactgacaaagaagtaaccggcacagcgcctgcccacaacaatgccagagagagcatttcagcccacgtgggtcgtatgagttcattatttgaattagccaagtgagcaacccccctcactggagaggagcctgctccgagatactaattgatagactcaacttttagaaattaacataagcttcaacagttgaatgatcttcaaaattccttccagcagccaagtctaaaatcctgaaatcagttcagttgtccattggcctgcttagaatcacagtcctattaaggcactggcagatcctgaatcagctcactaactaccccttctggtttttcttgcctcctctgctcatgttctccctgttttatccagtccactctgctgcatggaagagggtttactttggttctgtaagcttatttgcagaagtcccaatatttcagcatatacaacgtagccaaggtaaaattcatttatgtctacatttttgaatcacttttattcacccattctgccaacacagtggaccggccactagatgccaggcagtgtcatgtcacatcctataaaagtgaacaagaatgttccatctcctcaggaggtcacagtctatagagttgaagacaaataattaattattcatagtgtggtaagcactaccataaggatgaatttggagacacctagcctatctctggggttggaggaagggctcccaagatagctcatggctcagtgcatccagtctatatagtgagaagaggctgaacaaactaaatggcttttcctgtttataaaggtttttaacaaattactacataaaataatattgtaaatatgttacaaaggattatgaaaatataaattctctatctcctttcctaagagttcccttctcctcttaaattctcatccagtaagtcaacatcccatctggggtattcaatattgttaaattcaagagactttctaacctcggtgtttgtttccaagtttgactctgctgctatctgccctcggcactctgtggaccctcctgtcaggcacgttccctttcactcctgggcaacgacttgattttatgcatctcgtggcattggcttgtgtctacctggaatttttttatttaaaagttccctatcaaattaattatgttcccattgataggttaactcattttatttactgtcatgaaaggaaatagaaaagtttcaagtaacagccactttttctgttgcagacatactcccttcaatatatacctgctgaggttgagagtctgcaacacaggtgctataaaaataattgagtcaagatttaggagtggccacggtgcagtgtgccccagagcaatggattaggtctcatgagtgttggcggagtctgaattctcacgagcgtctgtctggccaagacctacatcagcaccgaggctgtctccatcccctcttccctccctggaccccctgtctgatcccagcagctcaccccagcaacactgttctaaagaggcttccatcctgacagttcttggccccaaaatatgaactagtttcgcagtgcccatgtattaaggcctcaggtttttcttctatcttttggagcctccataagctggattcaccctatggaatgtctttccctctttcccattcacgaatccctctgtttctctcaagtcagtctctttgctgctttcttccttatgctcccatccctacaggcaagactcctcctcttagtccttattccccccaaaactacaaggttcagctgaggcgcaacctcccccataagctttttcaataaaactccagataacatcgatgtgctattcactgtctaatttcttgtaatgtttacatttagaaagtattgcttttatatttaacttagcattttttttttgaggtggagtctcgttctgtcacccaggctggagtgcagtggcgcgatctcagctcactgcaagctccgcctcccgggttcacgccattctcttgcctcagcctcccgagtagctgggactacaggcacccaccaccacacccagctaattttttgtatttttagtagagacggggtttcaccaagctagccaggatggtctcaatctcctgacctcatgatccacccgcctcggcctcccaaagtgctgggattacaggcatgagtcaccgtgcctggcctaacttagtattattacatgttatttgtattactgttttcttttctttttttttttttttcttttctgagacagggtctcactctctagctcaggctggagtgcagtggcgcaatctcggctcactgtagccttcgtctcccaggttcaaatgattctcatgcctcagcctcccaagtagctgggactacagtcacctgccaccatgcctggctaatctttcctatttttggtagagatggggtctcgccatgttggccaggctggtcttgaactcctgacctcaagtgatccgcccgcctcagcctcccagtgctgggattacaggtgtgagccaccgagtccagcctcctttgtattgttttctacctgctttatgaacctgcaccaggtctctccaactcaaattcaacatatactaattggaaggctactatgcaccggtccctgcactagacctgagagggggatgcagctgttgctctcaggaagtctgtctgatgatgagaaaactcagtcagggacaccttggaagatctaataagaggccactcagtccaatgttggtcaggcacaggatatttcctgaaagaaggaaaatacaaactaaggccgaaaaagcaaaaatgagttagcctgaccaagaaactatagggaagtgggaaaaagatgtgaaaacacttcagatggagtaaaattaggtaagatcagggaaccatgctgtatacggtattttcatactgtcttctcaggctttattaaagtcccaaattcttccagaaattaaaaattatattaaaatataatgataatgcttctataagccacatacataaatctgcgttttaggtttatataatatcccaagtgtggttgaattgggttccattgtttacaacattttgagccattgacaataaactggctacgcaaaatagaaatacaaagccacgattacaagatggaattaatgtattattaattttctccagatgatttcagtcctggaagatacccatttgcctttagtctaatttgtgtattgcatttctaaatataattactgttgacaggttgaacccaaacataacccattaacttctcaaagtgctagattgaaaacattacaatgtaacaagagatattagaaataaaaaaattaacttctgttctttttaaaaagtaagttaaaagcaaagatgtcagtcctgttttgtagtaatttgttagaatgatttggtttaccctagctttcttgccgaggcttttatactagaaaacagacactgacatgtaattgtaaatagtggataaatcataatgaaataattgttgcgtgtaaaaagaaaagaaaagaaactaaaaattccaaagggtatttggcccatgggagaaaaacgcagctcataaaaaattatcacgatactttcctatcccccagttaatggagttatgttttttcaaggatgctcaaaattacgtttataatagtccaagttcttcagactctaatttcaggtcacattctattcagactgtcgatatgtataactaaaaaaagctcaagccagatttaacataaaatagtttctgggtcatatcatttgcacagagctgttatgtggcacaactatttagctgttggagatgccatctgtaatacatactaactcatgcacatatcttgtctttgtttttgcctctgtgcaaaacagctagaagcagataatgcccagatccactgcaaaagcattctgctaaattgagaaagatatgaagacagatcttgtttggataagaaccccactgtgaaataaattgttctgatgtatccccaaacctcatgacaggaagaattaatgtgctaagaatcagtccagtggccataaatgttagaagctatttaacataagaaattatttcagacacagagtggttttaaaaagatacatcttttgctgttgactcaccaaaaccctgcacaaacaattgtgtaccggtttttcattcattcttaaaatgaatgaatgtaatcgtatgctgggtcttttcttttctttttattctttctttctttctgtttttttgagacagagtctcactcggtcacccaggctggagtgcagtggcacgatcttggctctacaacctccggctcactgcaacctctgcctcctgggttcaagtgattcttgtgcctcagccccctacgtagctgggactataggcacacaccaccacatctggctaatttgtgtatttttagtagatggggtttcgccatgttggccaggctggtctcaagctcctgacctcaagtgatccacctgcctcagcctcccaaactgctgggatttaaaggcaagagctactgtgcccagtgggccttttatttcttttattagaggaatatttaaaaatcaggttgtctgaagtagagtggtttgaaatgaggagtctgccgaaaagattgtagacatcttaaaacagttcaacaatgaaaatgtctcaacatgagaaggtactgtgaaatttctaaggtatcattagatgagttcagcattaaaatattgacataagaatttctggcatatagtagataaaattattttcccaacttagttgtttttgcttgttttacgtgtatccagaaaaggattgtataccatcccaaagtattttccaaaatataataaaaatcaatatggcataacaatacaaatcaaaatgaattcagagccaggcgcagtggctcatgcctgtaatcccagcactttgggaggccgaggtgggtggatcaccaggtgaggagatcaagaccattctggctaacatggtgaaaccctgtctctactaaaactacaaaaaattaatcgggcgtggtggcacgcacctgtagtcccagctacttgggaggctaaggcgggagaatggcttgaactcaggaggcggaggttgcagtgagctgagatcgcaccactgcactccagcctgggtgacagagggagactccttctcaaaacaaacaagcaaacaaaccaaaccaaacaaacaaaaaaaatgagttcaggtgcaaacccaagataaaggaattcatgcaaagatgtgactgtccacccagcacatgggatgcagctggtggttgagcgaggtttgtaaagagccctaggagggtggtgtgagccggctgcagcattagctggcctcagaatcccatttctgtgaaacgaggacctgtgacatcagcaggttagatgggaccatctccagagactttctggatatagaggtattgccatcttcaatttatatgatcacaacatttcttttttatcgaaagcttgtaggacttaatcctcacttgaaagcacatacaaagcctattcatattttggatttcacctttcttgaattaatgcatatgctgcaagcaagggtgagaaactggagatttctagagattttactccctgggagacttatgagagggagatcttgatccagagtattccaggaagatcagaaaagatgttttggtgttaaaaacaaaaaaggccacaaaatattacatatagcttttagttttaaggctcctttgttcttttttcaactaagtcagctgatcaccagggccaggcacgcttacatggaagaagagcctgtgcagacaggctccctgggtcagcctgggcctccctgggtcaggcgcccctccactgtgctcggggctcccccacacactgccctcacccttttcatcacaggtccccggggtactcacccactggcttcaatgtctatgttctcgccagactagaggccagaaaactgggatttggccctcagactgcttttgccaataaagttttattggaagccagccattttacatattactcgtggctgcttttgtgccataatagcagcattcactagctgtgacaggtcctagatgggccaccaagcctaagttacttcctatttggcccttatcaggacatgtttgcttattcctgttcgaggctgttgactccacaaacacagggctatctttctgtattcccaatgcctggcctgtggctggtgtttggtcaatgtttatgttctcagtgactgacagtttgactcaaggaatgaatgactatcaaggaacagggacaaaagcgaggcaaacaacaatttttgcagtgtccagaggtctgcagtagatgactggttttgagctaagccattcaactgctgtcaaaagctgaaaacaccatctccccccatctgccagagttaggctcatccgttcagagagctgagtccagtttggagagcacccaatacttgcgacttccacataatggaaaggaaaaggcacaagaactttgaagagggcaaataggacaaagaacatattgattcccttattgaacaaaaatgtactgcatgcctactatgggccaggcacttagcattcaggatgtcattgtctcttcagattggaagggataggtattaagcaaacaagtaaaaactagcaatgaaaagtgacagcaaggaaatgccatgggatcatgtgatagtgctggtgcactgcccatgctgggtggcctgggaaggcctggggatgggacatttgcattgccatctcaatgacaagccatgtgcaggtctggcgtaagagggtttgcagggaaggagcaagtggaaaggcacttaggtaggaatgctgggcatttgtgaagaattaatcagggggttagtgttttggggacacagttaccaaggaggcagtggagcaagatgaggtctgaggagatgaaggaagccacatggggcctttaagacatactcaggaattcagcgcttggacaatggcaagtcaggacaaaattttaagtagggatgcaacataataccatttatgttttaaaaaatcactctaacttgaggtaacgaatggactggagcagggctacaaaggaagggagatgcatggacatggtgaaagccatccaagtaagaaaagagagtgccgtggatcaagcagtggagagggagaggcaacgacaggtagacaatatgtttggggcaatcgagtgcttgatgtctcctacctagctttgctttcctactaccatttgcagatttctcgctttttaggaaatctcagaatcatgccccaacatccatgggttcatggttctaaaagtcacacctttcatattactttaaatggaaatgaaccctttctggttctaagcaaatttaaaatctttgcttagagcccagattaaatgataatgagcctggtaacaaaatactatattaatacagttttaaaactatagctccctttaaaaaacatccactggattgactgatcccctctaccatgcccagtgctgggcacagagcagtgggcatgggatgcatgggctctgctcccactgatgacctgttgtgggcagtgtctggcctatgaagccccgtgaggctgttgggggaccatagctgatatcttcaacaggggagtgacggcactgggggacaaaagtgggaggtgtcagatatttaggaactaaaattgtcaagattcagagactcattaaccagagtcagaaaggggattcaggcacaatgtctggtgactcttctcatcatttagtgaatgcttctaatgtgccatgtttcctgctaagtgctttctcggcatcactattttaatctgcagaatgatctgcagaatgattctggagggcagggcccactcctgtgttttctctgcaatctcactgcctaatgctgggcctgtacctaggaggagctccaaaaatagtggcttaatgcatgaatgcatggctcccccacccctcccatgacaacaacagtgaaatccctaccatagagaaggacacgggaggaaacggaggcctagggcgctatcaaacacccactgtccacagcccaccggtgacggagcaggcaccagagccagcgctgcataagttccacccacattcctcaattccgcatgccagggcccggcctctgcggatgctacggacatttgctgacacagtacagtgactggaggagcagcagggctggaaactgagtcttctggttctaggcttgctgagtttgagatggctttgggatgtcccagcgaagatgtgcagaagtcagtttagttcacggttctttcgggagaaagatggggctataaagggcctggggacccatccatggagagatggcaatcacagccatgggagcgggtggggccaccccaaggaaatgctgagattaccgtgtgactgatttgattacggggctttaacttattgagctataaacatcgaacagtgtcacggtttctaagacctgcctctgtgcatctgtcaaacacagtgggcaacaacctagagtccacgactttcagccacttttacctgtggctgcttttcagttatgaaaataatcgaacgggccttagatcagccggttttaaccttccatctcacacctcactggaagctctttcttccccacagtcaagaccaggaccggctccagctgcttcagatgtgaggcgcagggaaggcctgtgcaactgcgtgtgtccaggactgggcaccccaggtttcgggtgaacaatgggatgtaatgaagggacccctctttttcttgtctcccactggaatctgcttgcatacaagcaggtatttctggttttcattccttcattcaactaatggttgtgctgagggttaaacaacaggcaaggcagagaaagtttctcctcaaattgaacttgcagattcacaaggaaggtgacatacacaaacaaggaattcgtgctaaatgaagtgttaccgagagttgcaagaatggagaggagtagagaagactaaggaacaggctgacctaagctagtgtcaatctcagcaaaggctcattggaggaagagtcattattctccaaacagcaaccagaagatgctttcaaaatcaaagttatagcctctcactcctctgctcagtctctgcaatggctccccctggtcattcagaaaaaggtccaagtcctaatggtgactttaatccatcctctaagcctgccacactgccccttctctgtcccttagctccttctcttctcccactcgctgtgatccaggctcagtgaactctgtgaccctccccacacaggccccacatatgacacacacacaccccacacaagccccacatgacccacacacgccccacacacacaccccacatatgacccacacacgccccccacacaccccacatatgacccacacatgccccacacacacctggctcccagcctttctccggctcctcctgtgcgagcgtgcttccccaatggtcacgtggctcacaccctgccctcctgcagctcttccaatgtctcctttgcaacgagcccctctaaccaccacctgctcatgtaaaacggtggtgaccccaccctacattcccacattcccaattcccatggcctgttttagtctttgtctccataacatcaatcacttcctatagtagatttgccttcttactcgcaatgcctcaaccctccctgttccccagccattgacctgactttgtctttcctcagttagaagctgcatatatttccccatccagttgatggtgagctgagccacgtggctttgtagggtggctgaatatgtcaccccaaaatatgccattttggccatataattacttaaagctaaaggcccttgaaaaaaacaggtgatgtgagaagggtgttctgatctccccttttatacctggaaacaggagatgaaaactcccatgtgaaagacaccctccttgcatgaggagaaaaaccactcttcaattgggacttatagcagagtgaattctgcacaaacagccctcattagggtatgtatgccttatcttcccttagcctccaaacacttgagttacttttccacaattgcctctgctggttcaacccaacacaaaagaatgctggttttgccacttctttgggtcttcatttcctaatgagggctcctgtgtcacataacgcttttattaaacttgcatgctttcctcctgttcatctgtttcctgtctatttcattctcaggcccagttgggactctgggtagaagaaaagctttgcctcccctgcagcttcctttgccaataggatagtagtgtatgtgacataatccagtacgtggcatgtgcttgtttggtgaggcctgcccttctgaattcctgcctttcaccacgagaagaactgtccttgggtagccactggcttaaggatgatggactcattgagcagactggaaacatccacattcactgcccgaagcagggccaagctcagcccagccccagctcaactcgggtggagccgagaggtgtgagaaggctggacgtagtgtcaggggccagtgagctgcccggtttcttagtactcagccatagctgaccagtgaccttctgtacagttaccgatttattagatgtgtgacctattgtctgtctcttatcacaagaagggaagctgcattagggccgagagcttttccgcactgctgcctcctaagttcctggcatgtggcgggtctgcgacacagatgcatttcataaaggaagcaaagacctcaagtccgaacccccaccaaagtgagaagcaggagtttgtcaggtactatttcgctaaaaggaatgaaagaagatggaaccaaagaaggaggcggtgttgccgatgtgtagaggtcagaagtgggcctgctgccatcagacacatggggggtggcacagcctccaggtgacctgcagctgccacagcaggagaacactgacggtaacacatagcaagtgcacggacgcctcagggacaggtttcaatgtcaatgaaggtcattattggctgagcagcacaagggttccctaacaatcacgaataatgaagagcgcagagtatccacccatctcccaggacactgagccacctgaatgcaggctcgacacccaagaggagagaggacaatggggcctgaatgaacttggggtgatgcagcagcagaacttgatctatgaggctctggtgatgagcagtgtggacactgataggcaggtgctcagatgctgccagctgtttttaggtttcagaacagaatctttggggcagctccaccaacgtgcctcgatgtaggaggaaggcaaggctggtggccttcagctctggatcctgcaaggacatctgaaatctgcctctgccatctgcctctgaactccctctccatccccttccctcccctccactggtgaggttggacccataaggagaaggagaaggtaacttggaaggattgaagtaaactctggtgtattgaagagatttggagacaaggttgacaattcatagaaaataaatcatatatctattttaataacacttagctatatattaattggcaaactctgttgcatctacacattgtcccaacaatgcgttttagagttctgcaacaataataaccacaaaacactgaaaaagtttcaaacatcttccagcacttggaaacaaattctagattctattttcccaatctattgctgtctatgagcagtgctatggcagaagggcctaatccagtactcaactttctaagcctgacattttccacatatgtaaataggtcttcttgaatttctattaatacttttatagataagaaagttggactattaactgagactaaataacttgccaaaggtgacagagtggtttggcatcattcagactatgagtttcaacatacaagtcatgagaatctaggttatcgtatggccactaaaccacatttccactttgcctcccactacaaaagaatgcaaattgaagaaatttaacagtgggaggcttctgaatacagtcatgaattttctgcctgggctactgtagaaacaatgtgtctcaattcacagctggtatgttaaaaatcatcttccccaagtcaataaatcccctctgtcgcctcaacttgaaactgcctgttcttcgttcttcatgtttactcgatgcttatttccatatcgtgtcacagaagcagtgccttttccaatatccatcctcacagaccttataccctcatcacatctggaagcgttcttctggataagcatctgaggatgccatcgaggtcccgctagggagccctccttctgtggccttcctgagtacacacatgcacacacacacacacacacacacacacatgcatgtacacacacatgtacacatagagctccctgtttgtgctttcatcttctgatgaccagatcctgtctttactatttcctgttgctctagtgagtctcttccagggctccagcgcaggccctccgatggccatcactacccccggctcctctgtgtgcattggtttgcacactcttctgacttcatttgctttacaatgaggcaaggattctgttttctagaacacaggagaattatcatttgatgtgtctgaaggatctttattgcaggagaaacagctgttgatggagagccggggtggttgggggtggaggggagtggtgatggtatccatctcagctccaccttgaatagatgctgtccctcctatttgccccatgggtccacctggcctggaacactctaaatgcagcaagtccacgtacacctgtgctgcttctgcctgtcagcagctctgcttagcaagcttagccaagagaaagtcctgctcctcattagggtcgacgagttcttccccacagagcagcctactccctggcataggccttctgggatgaactggtgcccagaagcaaaatcaaaaaagaaattccatcgtaaatattggagattcattttctgtccacttcaaaatcaaggcctctgatgatcaacgtgattggtcgtccaagcagccatgtcattaccaacctgccccacaacacagttgctcacacatgaccagcgacagctagacaccaaagtagtgaagcagcctgcccatctgcagcagagggtcccacagaggccaccgctcctggaactgacgggccctgatatcgcacacaggaacagcactcacggttgtggcttcccgaacacaggacagaggcagcgcatgatgtttggactcgaaagcacccgcatcatttctcctttcccaactcatactgaactctgcatggacaggttccctccttagcagcaaaacttccccagtcagacttacaagccagacttgcccagtctctcttgtttcttcaacaagagagagttcagaccctatgtggctatgaagcacctcaccaggtcatccctcgaggaggctggagaaggaggcagctctccaccgagctctgattctggaggagcgagcaggctctccacctccacccagctcttattctgtaggacggaacactccaatgcaggatgcaagacaagattcatcactaagctgttgcctaaatgtcaatttagcctttattgaacatccatctggtatttgaatgtgcattggggatctgggggaattttgtttagaaatagaaaacacagacccttcttcaagaggccataatcgagttggagaaatgtttgatattaagctgtaaagagagtcacgcaggatcaattgagaacatgtgaaatttttcgcaaatagtgagaaatcatccgaacaccacctgcataaaaacccacctaactcccactgtaagctccatctgaacctaatgaggatggtagttaccgatttccaaaaaggttgtcttcattcctttgatttgcgctgtaagtgttaaactttaaaaatagtctaaaggtactaaaaatgatttcatgtttttctcagtacaattttgttaggtttatgtttaattagccaagtgttacattgaggatatgagaacgagcaatattctgttgctataaatccttcagttactaaaccatacggagatttcagtaaagagaggtggaggcaacagtcacacgtgtgcacacacacacgaatacacacacatacacacataaacatgcttatacacagatacacgcatgcaaacatatatatacacaaagatacacgcacacatacacatgcatatacacaaacacatgcatacacgcacagagctacatggacacacacaggtgcatacacacataaacagacacatatacacatacatatacacatagattgctagggctgccatgacaaagtaccacaaaccaggcaactaaaaaaacacaaattgattctctcacagctctggaggtagaaagtcaaaaaccaaaggccacgcttcgtctgaaacctgggagaggagcctttcttgcctcttcctggcttctggtgttgccagcaatctttcacattccttgtcttggagatgcctccctccagtctctgcctctgtcccccaggggcagttcccctgtgtctcctcacatcacactgcctctgtacgtcttccctctcctccccttgtctctcgtcctataaggacaccagttagatttgattaaggccctaccctactccagtaaaacctcatcttaacttagatcttcataacatctgcaaggactccatttccaaataaactgccactcacaggtaccagagattagggcccaacatctttttctgggaacacaattcaacccacaggtacacacaccctccacaaacaaataatgttggcttagtttttaattaattgtgctgaagtgatatgtcatttacattttctgtctgagttcctgtattgtgcgatcttgaattttccagagtaattgacttaatctattcatttctaagatacagaataaggtacccctaacttttaccattgcatagctcaggcaggactagtataaatgatgaagacaggaagattattaatattttcatcacagacccctcatattttcattatttaacacataataatcttctaagactactcaatcttctaataatatttaaattttcaatttaaaatattatttttattctgcaaaggacatcattgggtcagctgacaaaattggaaaacagctggtaacttagataaaagcactgtatcaatgttaaattgacttgaataactgtactgtcttaatgtaagagaatataagttgcttaactgaacactaaagtatttattagtaaaagaccatcatatctgcaaatttctcttaaatagtacagaaaattgtaatgaataacgtgtgtgtgttgaaagacacagaaaaggagatatagcaaatagggtgaaatatgaacaatagctcaactgtgacagatgttataaagggtgttcttaatattatttttgtattatctataaatttgaaattttcaaatgaaaacttaaaaagagattaaactgcatttttaattgtattgagagatgagtctaagaaacaacaaaatacactctccaattttcaaaccatgctccttatcttggtgggaggacttcaaaaaggtgccatagtcatatgacaaatgaaaagtaattaaacttagtttactccattatcaagactgcgataaaagtcatattctggtattttgttctgttttgttttgttttgtttttcagacagggtctcactctgttgctgaggctggagcgcggtggtgcgatcacagttcgctgtagcctcaaactcctgagctcaatcgatcctcccacttcagcctcctgagtagttgggaccacaggcatgcaccacaatgcctgggtaatttttgtatattttgtagagatggggtttctacttgttgccaaggctgatctcaaactcctgggctcaggcagtccgcccacctcagcctcccaaagtactgggattataggcataagccacagagcccggtcagatcatattcatttaactttaaagttgaaaggatgacacagatagaaaatattttttagttataaataccatattgggtgtaccccttacccacacatcaacagtcctcaaaggcagggggggaagggggatgactcagaaatcccgagtcctgaggaattaccacttggggctgggtacttgatcatacgagaaggtgaggaggtggattctggacttgcatttatggtgacaatgaatctgaagtacaatgtcaagggtttagataacaatgttaagaaaaaaatgttagggagaaactgggtcaaggtatatgcattttggaattattggttctgtgtgggctctagaaataaagcgacaaaaaaaatagcaaatatcccagttgcttaatagcttattgtcctgcgtagcgaacttttttcttaagggaaatatctattttttggatttaacattatttaacatgtaagtcaccttattcactcatcaatttttgaaaactaaaaatataaatcattccattttggtgataaaattttaatttcctatactgataataaatttttccttgacaaatgcacttagggcacccttcacactgaaaaactacaagagacaagtcccacatcatcaacagaatgtaagaatgtaggtggatgaaggataccacctgagactctacatttctgttaaactggcttcaaattattaagtagctaatctaaacaagtgtgcctgtttctgctctaaagcaatgtggaattctttcaatcccttaggacgtgtttttaataataaacttttaaaaatgtgtttaataaaatataacaaactttataatgagtattcatactcatacatacatagtattacaggttgagctgtgcccccttaaaattcgtgcattgaagtcctaacccctagtgcctcagaatgtgattatagttggagatggggccttcaaagagttaattaaggttaaatgaggtcagatatgtggaacttaattcaacatgactggagtccttacaagaagcagagactatgacacagatatgtacagagggaagcccatctggagatacagggagaagacagccatctgcaagcgaggaagagaggcctcagaagaaaccaaccttttcaacaccttgatcttgggcttctggtctgtgaggaaatacatttctgttatttaagccacctggtctgtagtaggcagcctgagcaaactaatatacatgtatattttagttttgtctaagaaaactcttgaatggattatgacagactggaattctagactgataataaattactgtgtgacctccttaaaatttagagataagaggaggtcctagacaacgtctaacgtttcatcattttatacccatatacaaaagctttttttctgaaacagaaagcatcataccttggttgggaagctgacattcccttggatcaagacatggctgctaactgtaggagtgactacttatgtaacagtcattcaaatgaaaatacctatgctaaaaatgattatttgcaacattcatgtatttacttcttattagacaagtaattattaagcatatggcatataccttatactaggcattggaaaaatcaaaaaataaaatacagtcattatccttaggattctaattcaaattcaacacgatgtatgctatagcagagacataaatacagccaaggtggtgtctagctttacctggggaacttgaggaaggcttcccagaggaggaaagtcttttgagctatatctttaaggatgggcaggggttcgtctgatggggaagaggaagaaagggtactccaagcagagggaagactatctggtaaaatagtaattctcaaaatgatctgtagattcgaaataatcccttttgaaatatcatcaaagtttttaaagaactagacaaactaactctaaaatttatatggaaatataatgatctgtattagccaaagcaattctgaaaaatgaaacaaaatctcaggccttaaacttcctgatttcaggacttgctataatgcagcacacaagccaataaactaggccaatcaattgtcagaaagaaagttttctgggttttactaatgattccaagcagtaattgtcctttagtttctcaaaaaaaaaattgtttaattttctagttcacctggcaaaatgaaagacagttttagacatcatcatatacagttacagaaatcaagccagtgtggtactggcatcaggatggataaatagatcaacagaacagaagagtgagtctaacagaggagccaaggtagctcaacgggagagggctggtcatttcaatatacggggcttggacaagaggagaaacatatgcacgatagcaacagtaacataaccattgtcccttacatcacaccaaacacaaagattaacaagaaattgaccaaggatctaaatgaaagagctattactttaaatcttctagaaggggccgggcacggtggctcacacctgtaatcccagcactttgggaggccgaggcgggtggatcacctgaggtcaggagttcaagaccagcctggccaacatagtgaaactccatctctactaaaaatacaaaaattagccgggtgtggtggcatgcacctgtagtcccgctactcaggaggctgaggcaggggtatcgcttgaacctgggaggtggaggttgcagtgagttgagatcgtgtctttgcactccagcctgggtgacagagcaagactctgtctcaaaaataaataaataaataaataaaaattaaaaaaaaatctagaaggaaaaatataacagacattttctttgtaaccttgagcaagacaacaatttctagataagataaaccaaaaaatgaacagtaaaagcaaaaaatcaatatattggacttcatcaaaattaaaattaaaatgttgttgaagccaggcatggtagttcacacctacaatcccagtgctttgggaagctgagacgggaggactgcttgatcccaggagattgaggccagcctgggcaacacagggagaccctgtctctaaaagaataaaaataaaaataattactcaggtgtggtggtgtttgcctgtagtcccagatactcaggaggctaaggcagggggtgggagtccctttaggccagaagtttgaggctgcagattacggcactgtactccagcttgggcaacagagcaaaagcctgtgtccaaaagggggaaaaaaaactttgaaagtcaccataaagatgaaaaggcaaccttcagactggcagaaaatacatacaaatcatctgtctgagaaaggacctatgttgagagtatacataaaaaaacttacagtttagtattaagaaaacaaccaagcaaccaacaacccaattaaaaatggagaaaaatttgaatagatgccacagtaaagaagatagcagaatgtcaaatgtgcacatgaaaagatggtgcagatcattacacaacagggaaatgcaaattaaaacaatgtaagatattatcatgcacctactaaaatatccaaaattaaaaagactgacaataccaagtgttggcaaggatatagagaaactaaagcccttaaatattattgtggagatactttaaaatgttttaaaaatagtttggcagtttctttaaaactgtaaagtttctttaaaaattgaatatatgctaccacagagtttggcaattccacaaagtctgctcccaagaggagtgaaaacatgtatacacaaaggcgtttacacaaatggtcacagcagcattatttatgatagtcaaaagtgatgaaagaattagaataaaacctgaataggacatggaaccagaagttttcaggcaggaagtaacaaagtgaggcttgtttattcaaaagataaatcagacatggaagttggactgaagcaggtgagagactcgtagcaggaagaccagatgcttaacctccttggatggattctgttttaactgacaggaagacagttggatttcctaaaggagaggcttagcttgtgggaggaagtgcagtggaaaggatatgaacttctcatcatcctggttcagcatcccaggtgcgcacctgagcatgtgagtccccctttgcccaacctccagtctcaggcgcctcacccaccacaggaggggatgtccccagcctcaccgggctgcggcgaggcggtgcagtatctgtggacagcttctggctgatgcctgccacatgggtgggactcggggtagctgagtttccttctccttctcttctaacttcttatccaaggaaaaggaaaagacctgtctggccttccataatcagtaaggtaaattcatccatccacagagaaaataaccgggaagcctacagtgcacattttctctctgcccccaccccctatgcccatgccgcatcaccatgacgactctctgccctgccaggcttgctctgcatcccagaaagttgggcccttggggctgtacccacaaggctcccctgatctctggctgccagctgccacccagctctgggtcacattttctgacagtggcttcatccttccctgctacagatcctcttggccatcctcttcctctcctccatgcctcctggagctgcggcagcactaagcaggccacttacttctgaaagactggggtgctgatggagctggcagtttctgggttcctcactaccactgcccacatctctgcaaattcatctttgtcattaaagcatctagaattatttggattgattctgtttcatactcagaccccaattcaaagggtctaaaacaggtaaaatggacagaggtggggcaaatatatccaaataaaagaggatccttttatcttatgctcagggccttgctgacagaaggtagcatctttggtgatgcgacgttttttcctctccaggagcaaacatccaaggagcacaaactgccagtctctagttgtagtgagcaacactggctacactgctttctactcttattcaagcattgtgctgtgagtgaattaatattgtgctgtttccattcctgttaaaatattcttcatagtgacaaagaatacacaaaaatgtccagactgacataacggtgccacctgaagcataactcttggaagtcaaatgtgctgtgaccaaagaggtttctaaagagacacagtgtattcgtccattctcatgttgctaataaagactcacagtttcacatggctaaggaggcctcacaattatagcagaaggcgaaagaggagcaaaagcatgtcttacatggtggcaggtaagagagtgtgtgcaggggaactgcctttttttcttttttttgagatggagtttcactcttgttgcccaggctggagtgcaatggcccaatcttggctcaccgcaacctccgcctcccgggttcaagcaattctcctgcctcagcctcccaagtagctgagattacaggcatgtgccaccacgcccagctaattttgtatttttagtagagacagggtttctccatgttggtcaggctggtctcgaactcccgacctcaggtgatctgcccacctcagcctcccaaagtgctaggattacaggcatgagtaaccgcgcccagccgggaactgcctttcatagaactatcaggtctcatgaaacttattcattatcaggagagcagcatgggaaagacccgcccccatgattcaattacctcccacagggtccctcccatgacacatgggaattatgggagctcaagatgagattgggtggagacacaaccaaatcatatcacacagtttcttctctgaatttatgggtctttgaggtacttttatgacaatgagaaaaactctctctaggtgtgtgcaaccacataccagggaactaagtctagggaacagaccataagccgcatttcatccccaattcattgctgcagccaggtatgcctgtgcagtatacaacctacacaactgcaagtggcagccgttacttcatatgattctaggacactcgcacttacttcttggactcaattttcatatgtataaaatgaataatgctatacacttttcacctagctttatacaactagaggtattgtactttgaattcaaagaactataacttatctaaaaacattcaggtatacaaagttcaaccatccaaagtgttcacctatacaaagaaaagttaccattcttttgtgggctgattataggttacttagcaggggactttttgttcctggtggttaacgcagatcctaatatccaacttggtcaactttcaaaagtgccttatcagactttcacttctggctacaatggaataacaagcactgaatttatctccctccctgaagcaacctaataattccacaaaatatatgaaacaatggttttcaagacagtgacatgagacaatgtgggacaaaggtccgtgagagacaggaagcaagcgtgctgagtcctgcaatcactccagcctcctgccttcagagagtggccaggccctggttcagggagggagaccccagcgggagctcagcagacttgcggaattgaacccacaggtctgtgtgtagggggaagacggggcagctggagttaacagaactgagcagagagagctgcacagagaagactagaaaactgtacgacgggttcacctgaagcgtctggctgctggtgtaaacctgcgctttggaaaatggtatgcacacgtacactcactatggaaaaatagtttggcaatttcttaaaaaggtgaacatgtatctaacaggagatccagccattcttctccagaatttctaaccaatgcagagaaaacccgtgtgcatgcaaaaacttgtacacaaatgctcctggcagctctgtttgaaatagccccaaacaggaagccacccaaatgttcctcaactgatgagtgaataaactggtggatccctgcagtccatgtggcggcaggctgctcagtaccaacgaggagggagctgggacatatgcagcagcatgcgtgagtcttaaaataatgatgctgtgtgaaagaagacaagcagaaagaaacacacactgggtaactccacttccaaaacctctaaaaaatggtaactaatctatggggacagagaacagatcagtggtctccaggagatgagaaggggaggcagagtggggtgggagggagagaatccaaagaaacctgaggcaattgtgggggtgatgggttcactgactgtgatagtggtcttaccggtgtatacatgtatcatgactaattgaattgcacactttcaatatgtgtgttttatcacacaccacttatacctcagtgaaaaatttcatgcacagaaaaaaggtttaagaatacagtggcttgtttaaccaaagattttcatatgtggctgtcttctcacaatgcagctggagggaggccacaagaagaatgtgttcacaccccaggagttggaggttgcagtgagccgagatcacgccactgcactccagcttgggtgacagagtgagactccatctcaaaaaaaaaaaaaaattgttcatgcgcagtcactttcttaaccccaattttgctattgagcaacgtgtaaaaggattgtcactatgctgcatttgaaagcatgccctgtttcagatgtcccaaatggcaacagggtcactcacaaagagaacagggttcagtatatgccttgattcctgtcctccaaaacggtacccataggtaagttctccctgcaaaagggaactgaaaaaatgaggtcctggctttgggctttcattactttcatacacacacacgcacatgcacacgtactcacacacacataaagtttttgttttgttattctaatttgtgcttcgatttgcccaggagactgggtcctagaatttgatcaattctaccttcccggtccactgctagagaattaatctggaatcacattaaaaactcctggagcccccatcactatagcttctgaaggaaaagaataggaagaaaaatcaatgtgctttgtgtattcacagacttctgataaactctgggcatgaatcctgtctcgattttaagaggctctaaatggtagtgaattgtgagcctcactgcagagctaagaagtagccccctcagaactggagagtaaacagggccacgtgggtttcccatgcccagtccccagggatttagacctagtgtatgtttgtcaccaccaactagtgacaaggacaaattttccaattagaagaaagtcctttatttgaaactatatatttcccagatttcctgttaaaatgattcccttttattaagtgatgttgagactagatacttttgttactgtgtttttaaacatccttacatggtaaaatgaaatattgtaaacctatattgctcagtcctccactttatttttaagaaaagttaacttgttaataaaactgaaaagtcttaaatgtatcaatacttgtcattgcatgtggaaaattttatcgacattttggttttggtttatatagactaagttacaataaaaacaaagaactgtgaacacaatcacacatgatcacgaatgacaacgctactcctacagcgtaagaaatctcatcttaaatttcctcaacccaatattttcaaaaagaacttgacctgccaagcttccagaaaacacaaataaggaggcagaataatcacttcccaccgttgctccaaggagacccccgaagagcctgaagatgtgaagctctgataaggtaactaataattccttggatagtctactggcgtaggagccatggaaacagagaaacagcattggcaccaatgaaggttaatcaaatcataacacagacatgcattttattactctgacggcacacagcaacacagagttatcaggtgcagatgaacctaattagattgggtagggggaaatggacagctgtgaggtgactgctttgagctctcctgaaagataaggtcagatttaccaaagacacataggtggaaactcaaagaccagtttttggtagaggggcaggtccttgtgagactcagtcctactatcctgaggtcaagaagttcaaaacaaagtggaaagactggacatctgattcacttgttttaattttttttttttttaatttttagagatggggtctcactctgtcacccaggctggagtgcagtggtgcgatcacagctcactgctgcctcaacctcccatgcccaagtatctcctgcctcagcctcctaattagctgggactacaggcctatgccaccatgcctggctaagttttgaatttttctgcagagataggatcttgctatgttgcccaggctgatcaccaacacctggactaaagcgatcctcctgcgttggactccctagtgctgggattctgggtgtgagccaccgtgcccagcccctagtcactttcaaacagaatttagcaagtttggaaaggttactagatagcaaggaaaaccattttcacagaaggcagtaagacagtagcaatgatgtaatttttccctcaaaaaaactagaaggcaagagatctccaacaacaagggcctgggaatttgacacacttgtttccacacacttcatagagctacgaactggagaagtctttgaatgtggggtaagatagggaaggtcaagccctgtaggtatacaggtgggcatgggagccagacggagtcagtggacaggtgaagagggccttatccatctaacatgtactgtggttaggcctggagacattcaataagtggcatctgagtgcatgaatgtttcaataccctcaacgcactgcggttatgttcttgaaaatgtacattgcattcaaacattatactccgaacttaggtgcccaaatgaacagtattgataaatggaaatttcatttctcatagagtccttgactgtcctctcatatcataaaaaataaaggggatacataggtagatgaatacagatgtgataccctttaaaaataatagcaggccaggcatgtgggctcatgcctgtaatactttgggaggctaaggtgggcagatcgctagaagtcaggagttcaagccagcctggacaacatggtgaaaccctatctctactaaaaatacaaacattagccaagcatggtggcatgtgcctgtaatcccagctactagggaggctaaggcaggagaatcgcttgaacctgggaggcggaggttgcagtgagctgaggtcacgcactgcactccagcctgggtgacaagagtgagactctgtctcaaaaaaataaaaataaaaataatagcaaataatgagcataaaagtaacaaagatttatgttaaactcctaaatgtttcttgtatctctataggtattacccccaatcaaattcccaaattaaataaattttataaaaatacatgcagagcttctaataacagaaattccactctactctaaggatgtcagtacaatagtgctattaaaaacacatttggtttacattcaaaggctacctttcagagattaaggcacatcacattttaaagcgaatctcaaagaaaaagtagataaatttattttatccaccactgaagtccaatcactaagcatagcagcagatatttaacatgtgcttagaaaatatttttcaaataaaaaatgatttatcaaaactcgtaagagatacttcaaagcataatatccaaaacagcataaaattaactggccaaattaagcctaaaaatattagtaataagtaacactgaaaaaattattatcctcagtatataaagagctcttacaatttagtaaaaacatgctattatcaagccacagaaaataggccagtgacataaacgtacctatcccagtaaatgcttgaaactgtttaacctcattattaatagtaatttaaacttttttaccagaaagagagcattttgctcatcaaatttacaatctttctaaaaattcaataaccaccattgaataaaaattcaatggtagttagctctggcaaaatgggttcactcatacattgctagtgggaatataaattagcaaaacctctctgaaaaacaaactggtaatataattcatatcaagagttttaaaaagtttataactttcaacacagcaactcctagtaataatctctcctgtgacaataaaatatatgggcaaagatggtgtatgaagatgtttattacaaataattttttaaatatttatattttcatttataatgttaaagtttatatgtttataaatatttatataatatatactatgtaatttttcataatttaaaaaataaaaattttattcatttactttataaaaaattacaaataaatataaaatatataaacaaatattacaaatataattacataatatacagtatacaatatgcaaatatttataaaaatatatgaataaaatttttattttataaatggcaatttttataagtataaaattttatgcataaataaaattatataattatatattcatttataggtgtatatatttataagcataaatatataaacaattgtttataaatatatttttaaattgcaaacaacttaaattttcaagaattggaagtggttatgtgtaacatagtatgcgtatgaagaaaatcattaaaataaacctttgaagtataaacgcctttggaaaatacccccaatatgacactatgtaataaaatcaatacaaaaactctctgtacagcgtgattctatctatactatcttatgaatataataattcacagacacagatatacatacacatttatgcatctaaaaaatggacaaaaagcccaccatatggttcatagcagtgaatgactatgtgtattatatgttttcattaaaaatattttcagagaaaataatttttgtaaaaatactaattatataaagcaaaaagtaaaatcccccaattaccaaaaacccccaaacatactcactctttgtcctccaccaacatacccactgatatcagtctgaagcataggatgtatttaaacataaatcttttaaaaatataggcagaattaaatctttttaaaatataggcagaattatcctgtgcatatcgatccatcttggagatctttcctagcccgtacataatcatcattcttattaatgtctggttataattctatggctatataaaaatgtgtttaacccatcccaataaaagggattttttttttaatccagactttcactattacaaataatgttgtatgaaacagcttagtacacttctttctatcctctttaagaaacatatccagaagtgttaactttcaggaaaaagtgatcacacattcattttcacagacaatggcaaattttcctcctaattatccctaccactttatatccccaaaatagtacaggagagaacttacatccctacagccttgactgagtattttctttctgcttcacttttggaaaatatttccactggtgttctttttttttttttttttttttttttttttttttttttttttttttttgagatgcagtctcattctgtcacccaggctggagtgcagtggtgcaatctcggctcactgcaacttctgcgccctgggttgaagtgattctcctgcctcagcctccccagtagctgggactacagatgtgcatcaccatgctcagctgatttttgtatttttagtagagacggggtttcaccatgtggaccaggctggtcttgaactcctgacctcagatgatccacctgcctggcccctggcatctttaaaattactagtgagttcactttttaagttgcttggctattgacatttctattgataatggtttatttatatctggagctcagaccatttgctgttctctaatattcactcactcagtctttcttagcaataacaccccaatatttaatgggacatgcggtcatacaggatgaagactacattgccaagtctcttttaaagttagggatactcatgtgactaaacactgggcaaggggacatgaagaaaagggtttgttataagacttccagaaagtgattttaaaggaaaagtgcacatctttcctagttgttggaatgtagacgcaacagcagaagctgaggcatgcatcttggacgatgaataaaagacacatatggctgggcacggtggctcacgcctgtaatcccagcactttaggaagccaaggcaggcggatcacctgatgttaggagttcaacaccagcctggccaacatggcgaaaccccgtctcaactaaaaatacaaaaatcagccaggcatggtggtgtgtgcctgaaatcccagctacgcgggaggctgaggcaggagaattgcttgaaccttggaggcagaggttgcagtgagccgaggttgcaccactacattctagtctgggcaacagagtgaaacgctgtcaaaaaaaaaagacaaatgttttggatgttacagtaacaaaccagaggggtctcagatcatgataatgtttgagaagccaccttaccagtcattgaccatttacctctggacattgtttatgtgagaattaaatgtttgtcttgttaaaaacccttttatcataaattttctatcatcttcaatttgacctaattgtatcctttgccaattttttaattggcttgtttacttatatccttgccaatttttttaactggtttacttattaattatttattttttgagatagggttttctctgtcactcaggctggagtccagtgacatgaatgtggctctgcagccttgaccgcttgggctcaagtgatgctcccacctcagcttcccaagtagctgggacgagaagcacatgctactatgccaggctaattttttttttttttttttagagatggggtctttctatgttgcccaggctaatctcaaacccctgggctcaagtgatccctctgccttgttcccccaaagtattgggattgcaggtgtgagccactgtgcccatcctggtttttctttttttcctgttggcatgtacttctttatgaaataaatagaatttcttctgtcggcagcaaatcatgaaataaattccattcattcatctattcataaattagcttaataattcattatcatatgcaactttcacccaaaggcaatgcgtgggtgtggctatgggtgtgatgggctgggtacactgcagacactaggaggaatccaaacaaacgaatctttaaaatcctgtccataagtgtatgaaatatttggcattcaagttaccctaggagaagaagatatttttctcattttcagtaaagaaaaacagaaacctaacttcttgcttctttcattggccgaaaggatggtattacagatttgctttaagagaaaataatctcaaaatctcatcttttaaaatgttagggtaacccattaaagccacatttggcaagtcaggtttcatgactgcagatgcaaatatttaggtgcacactcccttggtgtgcaaaccccgtgcactgaggaaggtttttctgcgaactgctgaagctgaagcttcagggctgttcacttgcttgggcctgtcaggaggtctagtgaggactgagcaaggtgatcacatggctatgtattccccaaaatttaagaagatattttcacagctgttgcttaggacaggtgcccctttccactccagcactgcctctggtagaaatccccctgtgtcaggcggccttggagtggtaatgggtatttgggaagctgagctatatatgtgcagtttgtctgccatttagtgagatgtggtatggagtttacagttattccttcactgaagtaacatactcccaggtgtttcagtgtaagcatggcttccaaggatcctcctcgcacagactgtgtccacacacccacccaacgccacgaagtagggaagatcagagttctgatatggcacccagcacctgaaacgtgtggatggagaaaaaggaagcaggtttgaagtttagggagccagaagcctgtctgtggataattctttcaatcattagatgtgccaagtcataagtgcaaggtgcgattctcatcaacaccttgtcaaacagaagttcattttggccaagaatatacttgataaggccttgtgcataaacacaaatgaatcatgtacgctttttgtttattttaatggaaaccacttgagagagaatttaccggtatttccacacttgaagtgcagaaacctgtagaaataaatactacagtgaatatggcagttatgaagttgcgtgatttatacaccctaatgtactagatcatgtcttactgtatcggaaacatctcaaaccaaagaaatctgggctccagatgaaaatagtacacaaattgccacatcctaacaaaatgcctgcagaagcaagtgctatattccagtgactaaattgctacatttatctactaataatgaactgcgtgtagcaatgaacaggccattcaagtatttgctaattaactaagagaaataatcatagggccacattgaaaaaaagatttaaatgttttcctgatttgacatgatatactaacattgactaagataacattcatttcataatatgccaacacaaaaggacatattgaagacatattcattgatgagttttgtcaattgatcaaatatgtaagcagtcactatgcaataagacttgaaatgctctgcaatcttacacaccagaaataatggaaaattattagaagttacctcaaatttgaaaacaagcctcaaagttgtcatatttccaataatttgtaaaactaaaaggtacttttcaaaaccatcaataataaaaataaattgtaatcgactatgcttggaagactaaattattttctattctttttatacaaagcaatacaataaaagtcatatgccaagaggcatatgaccaaaaatcataggaaaaagagtattaaagggaatatcacacagcaagaaaattgaaatatgttatttttctaaaagtatgattttcctggtatctactgaatttttaaaatttataatctgttgtaattttcttattatcaattatagtaatacttttgcattctgtttcttaaagaaggtctcccaaatggtgtaatttaagatccccacaaaatctgaacttgtctctgcttagttaagcacctcctcaggaccccttggcctcgtcaatatttccaaaatccttctggtctgggctgctcatggccatgtccctttccaggaagtgtccttgtcaaactctcaagagatttaactttaaccaagttagtcctgggtttacccggccctcatccccactcaagggacttttcagcatggagcttccgctctactcccaagcttgaatgaaatctcttgatcttctgggcatggggttttgcttcctgggcaagtgcaaggaaatgtgatgtgaactggaaatgcgagggtgtctgctccccccgggacacaccttcatccatagtaatgggagacaggaggattctgggtaaacaaaggcctccttcccttctccttgccttcagagggctggtccaagttgtggtttcttccttgcaaattttcactaagagtcctctgtgtcatacaaacacacctgctaaggaccaactgtggctctttagggcccctgaagctgcggccggcaagaatgcttcgagttgcttctcatgtttccttgcctttattcccctctatttttcaccctagccatcccgggcttccaccttccaaagaaagtgtcagctctcactcttgccccaagctctgctctctagaggaccctggctaaaatgcaaaccatctaacagaaattaaaaagcctggcaatctagcaggtaggagccctcattactgtagctattatcattaccacgaagattcataccaaaacatgtcagtacggatgaccttgggtcactgctctgaaattcaatacaaggaattagagaaatgaatgaaattcatgtaaaaagtagaaaaatcatatttaagacaaattttaaaacaaaagaaaattaaaaataaattattagcttggaaaatgatagcataaaaatgagctttattttgataagctccattttgggttaagcttgataaatacaaaatacaatacatgcatctatttatacacacataggcatatgatgactatagcaaaaatagtatatttctgctcatccttgcagaaaacccattaatgtacaaatgcaaaagtgaaggtttctaaaagttctatttgtggacgtctgcacccgtgttttatccattgccatttttctcctatggaaggaggtgaccaacccatctcagacgcaggacaagcttccttgttccacccagtcagttctagacagatggccacaatacacatttttgaatcatgccaaaacaaagattgaatctggcagaggctttaacccataacttcttttcccaaagacattaaatacatttgcttggtatcctttctgacagcaccaattcaacagagaggcatgtaggaacggacacgctgagtgagttttaggggagaaagtcaggcaaatatgcatgatcgaaatagcctcccaaacaggaagacttatgttcttctctcttctggaaatctaaatcccatagtgtgtaattttgatttgcattggcaggacaagaatatagctcaataagatgacacagcaccacgtccaagtgtacacctcatacctgctcttcacaatggggaggcttaattgtaggtagggaatgagcttggaggactatgacatatataaaatgagccaggaaaattctgtctgcctaacttacatggattcatggccaaactgttctcctttaattaacacatctttccacatctcagataagggggtccttacaacaccacatttcttcccactcacacttaatcacagtgagcacgagctatggaaggggctctgttcatctgaagaccctgaagatgctgtctttttcacatgttgttttcctctcagatcagaggtagtctagggaactgagatttcccaatgggtttgagttttactgcaattaccagaaggctattgaaagatgggtttttagaatctgagcaaattatcactgcaggtaggtattcagaggatacatgtatctatataactgtggcattgaatttttaaaaaatataatcattttagactagaaattagggctctaccttgtattcacctcaattgattttacttttttttttttttttttgagacagagtctcaatctgtcacccaggctggagtgcagtggcgtgatctcggctccctgaaacctctgcctctggttcaagcaattcttgtgcctcagcctcctgagtagctgggactacaggtgtgtgccaccacaccgggctaatttttgtatttttaatagagatgaggtttcactatgttggccagtctgctcttgaactcctgaccttaggtgatccacccaccttggcctcccaaagttctgggattacaagcgtgagccagcacacccggcccttgattttactttttaaattgtagtccacttgctcaaatttggaaactaaaagacaacagaattctatttctaccaagttttattgactatttagttaccagctttactgatcacaaccaagtttactaactgactttgccttttctagagtgccaccgttctgctcatgaatttgaaattatactggttttcatgcacttattacatacataattattctgtgtgatgaacagctcaagaccttaggaataaaggaataaaagacctctgtgttttgaaaataagaatctgaataaatagaaagattccctttcaatcaaatcttatttaccacacaacttgtgagtaacctgcaaaatactgtaggcaataacagaagtaacagaccctgctcctttcctcaaagaattcaaaatttagtcaattaagccaaataaagccttaccagtaactatttagcttaataatttcttgtttttctggcactttcagaaaatgaaccctacataaagcaccaaaatatttttaatcttatttgagtgaatctttgatgtgacatcctgttcccaagagtattacaaatacgactctgtggttcagggtcttcacggcaaacagtgatgcacaacagcacggcagacccttgggagcaatctagtgctggctgcttcctgtgggccccccgacctcacgccactgtgcttctgcccaaaggggctgctggtttgcttttcctgcccctcccacaggcgtcagctctgcttcccgcccctctgtttctcactggctgcctctcactgtgctgtgttgagagagggcactaaagaatatgcagaacaggccaggcactctgtctctcagcactctgggaggctgaggtgggcggatcacctgaggtcaggagttcgaatccagcctgtccaaaatgacaaaaccccatctctactaaaaatacaacaataacaaaaacattagttgggtctggtggcagctgcctgtagtcccagctacttgggacgctgaggcgggagaattgcttaaacctgggagatggaggttgcagtgagctgagatcacgccattgcactctagtctggaaaacaaagtgagactccatctcaaaaaaaaaaaaaagagccggttgcgacggctcacacctgtaatcccagcactttgggaggccaaggtgggtggatcccttgaggtcaggagttcaagaccagcctggccaacatggtgaaacctgtctctagtaaaaatacaaaaattagccaggcatagtggcatgtgcctgtaatcccagctacttgggaggctgaggcaggaaaatcacttgaacctgagaggcggaggttgcagtcagccaagatcacacgattgcactccagtctgggtgacagagccagactcaaaacaacaaaaacaaaaacgaaaacaaaaacaaaaaaaacaataacagcagcatagtaagaagccctggaaagtgcaagtgcttttgcacccatgagctcctttgccaaccacagtctggtctgcagggctttcttccaagtagactgcactggtggcattgtgtttcgtgacagttttgttttgttttttcccttggagacattttgatgaatctaggcttttggcggttttcactgatctttaggctctctgtgctccctgcggtctgaggatcagacaagcgggttatgtcagactgacatgaattgaaacaggtttcctgaggtctctttggcctagagagccctgctggtggtcttgccccctgccaggtggatactaacgctcaggaagccactctcaggatgcagcctctgggtaggccccgcaaaggcctccgcagaaagctttgtggacagacgcccctgcaggatgccccggagagcaaagaaagcaaagggaagctgcagcccagctcctccactcccagagcctggtgaacatgtgctctgaaggcaccagagcttcgggaacctgtgtatgaggaccccaagtctttaaccttcatgccacttagcactaaatgccaaaaaaaaaaaaaaaaaaaatgccaatacaagaaccaaggatgggaatataacatatgtagcaagtgaacaagtttgcagagctagggatctgcctctcgccaagtccgtagcttggccgggagctgggtcatattcatgttggtgccctgcttcggctacactggcccctttgtccctactaccatctctcttattcacctcccacagcaatttgtacaggttacaccttactgtcccacttgtagggcgaggtcagtaaggctcagcaaggtaaaaatcaatttgcccaaaaccatgccccacagttaaggactggggttgcccctctggccctggaaccagagtctctgctgcgtgttcctgtctcctagtgtgtcggggttacctttgttttttttgttttttgttttttttttttgagatggagtctcgctctgttgcccaggctggagtgcggtggcgcgatcttggctcactgcaagctccgcctcctgggttcacgccattctcctgcctcagcctcccgaggagctgggactacaggtgcccgccaccatgccgagctaatttttttctgtttttagtagagacagtgtttcaccgtgttagccaggatggtctcgatctcctgacctcgtgatctgcccgcctcggcctcccaaagtgctgggataacaggcgtgagcccccgcacccggcccgcctttgttttactaataacaaggtgtcactgggtcactgctacttggcgcaaggcattttttacatttattagattttcctttttaaattgaaacataaaaattgtatatattcatggtatacaacatggtgctttgatatatatacccattgtgaaacggctacatcaagctaatttagctaacaaatgcattacctcacatacttatgattttttacttatgattttgtatgattttttaactgaagaataaatacaaactccttagcatgggattctgtttgctttgtccgcaacctccttctaatggcatccagcataccaaggagaagaaagaggtgcagcctggagaggaagatggccaaaagtctccctttcctatgaccctgctccccaaccacagcaagggaccaggtcatcaaaaacacaggctggccaagctccacattctggttcatctcactgttatccagatccctttttatcaacaggaaacatcagctctgcagtaacggttatatggtcctgtaagaaccaagaaagagcagctaactggcccataaaggggattgaactcacatactcagcctcattaggaactactttctaaccaagagatgcaaacaactggagaaacatacaggtggtctgcagtttccacttacagcattagcaaaacaaaacacaatgaaataaaaataaaagccctgtattaagaactgacctctatcccaagaatgatgttgattggatgtgaagctgtaatttgtccagatgtatttctaagtacatgtgacatgtcagctgcttacagatcatcggcttcctcctcacatatccagcacaaaatcaacacgaagtgacagagggaagaaacagcattgtcttgtgttctgcttccaaaaccaccttgacaagtcaactgacagcagaaaaatcccaggctccgtggaggttcccgattttcataacattagccatgcatttcaaggaaatgcatttcaagatgatcaacagtgaacttggcgagggagcactggttctgtgcagaagcagcagaaatgttctttgcctctcttaacattttgtggactcttactgtccagtctcatgagtgggaatttaagtgggaatgaaatgtaatctgggtggattcctttaatcatattgtgcaggtaaatgtcagctggcttggtaccctattcagaatccagaaaaaataagaggttcagggagggaaacagggagaggaggcagaaggaagagggtctgccacagccctttcctactacaacacaagtctgttcctggtccaagtccctgcagagaaggcttccaatagcagcagccactttgggccatgccaaatgactggggagccacaagggcctcttgggactccctcaggaaggcccccacgctccaggatccagcaactgtctggctgtcttgtttctgtccccatgtggaagtttctcccatgtaggattggatacatttaccaactggacacattactagattcacatgttcttccttttcaagtcattagtgccccattatttactcttgacacttttcaattagcaaccatttctgcaaaagagcaacttcaagagaaatgcaaatgtatattagggatgcctgatgttttaaaactcaaaataagcatagctttatggggacccatagaaccacgtattttgaaaatatcttagtactttcttgaatagaagtatggtcatgagaataatagcgttgtttttcagatggtaaacatcaatatcggccgggtggggtggctctcacgcctgtaatctcagcactttgggagtccgaggtgggcagattctgaggtcaggagatcgagaccatcctggccaacatggtgaaacctcgtctctagtaaaaatacaaaaaatagctgggtgtggtggcatgtgcctatagtctcagctactcgggaggctgaggcaggagaatcgcttgaacccaggaggcggtggttgcagtgaggtgagatcatgccgctgcactccagcctgggcaacagagtgagattccatctcaaaaaaaaaaaaaaaaaaaaagatcaatatcagtgtatacccgcggaactgtaatacaggccgatccctaaggcctccatggtgtcttacagccacacagtgtgacacaatgacatgcgccatcctggagcagggcatctcaccctccccattctctacggtctgtctggagaaagctttgtggcggcgcctgtgccctgcagggtctccagcagcatccccgctcctgcccactagatgccagcagccttctcctacttgggacgaccaactatgactccaaccattgccgaatgtctggctgagggtgggaggtgatagtgagtgtccccccatccccggccgattgaggagcagtcctagaggtattactatgatccccaggctgcagtcaataggaagcctcatgagacacacatacttgcccaaggtcacatacaattagttcactgtagacaatgcaacgtctactgtgtgctatggaacaaccgggaggaaggagacggagcccgctctaagagatggtgcccactctaagagcccccttttctgattgagctggtagcacagaaaatgtcttataaagccagggcagcctaagaagccgtgatccctggaatggggcaccgccagatacagtctccgggtggccaaatgacttctcgtcactgaagtgcttgcccggaggcctgagcgatttcctaatcctcttgcttaatgtcttctgaaaggctcattttaataagggaatgaagctgttttaagataagttaggtagcttataatatgaagtgctaatccctagcctagaaaaacgcaaaagaaaaggttttgactaaatgtctctagctataacctgatgctgttctaggaccattagcatttttttttccctgggctgcctcagtcttgacacttccttatctctcttcattggtgcgaacaatacctgagctctccctcacagcagccgtctcccacagactcccctcggatgtccgggtgggcaggtggggatggagtgagcagatcggggttggagtttggttatgcaaccattgagaagtgagatgagtctgcagcttctgcctcactgtatggataagtaagttgttgtgtccgaggctagcacccacgacagtggacacagaggtggagaaagggtatgtgggaagcagcactccagctctgttcctatcccatgggtcctgaaggagcctttcggtttcctactagatcttacctagaactatttagattatacatgtagttttgcagtaaacctagcaacttaaaggaactcatgattcgttttttattttggaagctatgtctcagaatctatgggaaaccaattacttagaaaacatggaactctggactttttaattgatcaaacactaaaagacagtgagcaaaagtcccaacctaagacagcggcacagacatcgtgtaagagcagccgctgggattcagggtctccagcacacagtgaggagaggccatgtctcagcttctccatccactcagtcagatcataaaactgaccagttttatgcactgatctaggagccgagaggtttgctgtataaatgcaaagtagtaatccaaacacttctcccttagtcggtctacacagccaaataatccccctccagaaaggcagtggggaaaagctccttcttcctttgcaggtagaaggcctcacacattctcactcttaaacgggtcaggcttctaaggcttcccatggaccatatctaatttacaggaaaaagactagagtacacagccctggtctccacagtttcaaaatagcctgcggtaactaggcattgttattatttaccagttcttatccataacttgtttgggaaatggtaataaactgatgctccgtttgaataacaccatcaatgaggtaagatactttataattattcttctacctggggaacacgctcattaggaacaagccggctggaagcttcagattgttacattgtagacactgcattctgcaaattgctggaagcactgggtagagggaggttcatgtgtgaaaaatgaggatgatgatatccacaggcagaacagtttgagggtttcagagaatgcaagaaaagctgatgctacacacgccctggctctcagggtggctgcgatgggaggggtccctcccaggccagggcaaccattctgggagacagcaagtttgccttgttgtaccattgcctgcctgggatttaaagaaggtctgtgggatgagccaccccacctagctacgtgatgactgaacatgtagcaaataagcctgtgagcacctccaccccaccccaccccggagcacccccgtcagcaggcagagcttggcctatactcactaggcatcatttctgcccgctgtggccaagtcgctctccagggtaagtccgtctcttactgatttcactaattctttctcccctctggagtttcaggatactgaaaactactcagcaaattctttaaaatctgaaatacgacaggagttaaatatgctctaaggaaaagggggaatcatttttatttagtattttcaaataaattaaagacctggcttatttaacccacaggatgggatgctgtgactgtcaccaatccatggggcaaaagggaactgacttgagcgtatggtgagaaggaaggggggcttcctggggcagggaaaattggaaaacagattcacgcagaacccccactccacaccccctgggaaacgtgcttaccccactcttccgtacccttgtttaatctgtgacattgtgattgaaatttgtcactctgggagttacatctgatgttacagcctgcagcggagctaaaccaaaataaacaatctgctctattctgcttagactaatacgacagtgatgtaaggcccgagacactggcagcggcaaaatgcttttcccacaccgcatgctgcagctgggccccatgcgtttccacgccggggataggcggcaccggcttatccacgcatggggagggttggggaggggctcaggcacaagtgcaaactttgcttgtaggcaactgagttatcctgtttcttctatcagccggcagcacgtgctcttaaggtggacttttaaaagcctttttaattttattttcccgggcatgggtgacccctgtctctctaagcctggagggtttgcaaacacgctaactggtggtggaagtgttcattgcagttcacataaagggtgtgtggctccagcacatatcgatttgaagctgcccacacagacgcattttcagttgtcttaaattaaatacccaatttattttttggtacatatttggttgcttgccagcaaatgactctcagtatattcaatggctttttgccagaaagatgacaggcttttttctttaaaaagggggtggcccctaaatagcttcctttctgaagagctcttggtggccctctggtttgtagcagctaactcggagtgcggcctttttacagccagctttgggggtgctaaatctgtgcatttttcaagcctcagtagttctggtctcaatgcagtagtattcgcttgctttcttttctcttttaaaatttccacacagggtcctgagagccctgccatatgtgggctactcatcccagcagcatgcagaggttctgcgatgccagtggtcacagggagtcccctcatctggtcatccttccatccaagatccctggctctggatgagggggaaattgccgtacatgattcagttaaaattccagcctgagtggcctcgattaaatccagcctcctacatgcaatcaattttcaattttatcacctcatacgaagcaaagcgtgaatgagagttcagggaacttggatagagataaagcagggtcctctttaatacacagatgcttgttaaacctgctcattattctacactgtgattttctacgtgtaaaccagagacgatcataattatcatatgcctctccaggatttctccacggagaaaaacctaagagtaagttcatcaaaatggaaggtagaaaacaggaagaagctaaaatgtcatatccaggtgcaaactagaagcccctcgtccaccctggccatgagctccctcccttcctctactaaagcatcccctgaaccggggagagggactccacttcccagttcttgggccttcactgctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcctgtcacccagcagctcacactataaagagcatcccctgcgctctgtcttaaggaatgggcactaaataaaagaggcagcatggtgctgttaatttttcagcataggggacgctctgcctgtgacaccagatggaagaaaatgtcctgtagcctcctcccccctcatcaatgctcagtcacacctctctttaagcatccttcagctttcccgagaaactggtggaaaatggtgttgtctgaaaatctgggaatttttcccttcctcctgctaatggcctgggttgaataaacattgaagaggaaaatttagaaaaatgaaagagagaagagaaacgctctacccctagatggggctactgtccgcaagcagagtgtgtttgttttttaaaattcagttcacttacagtgagactgagattaggtatcaacagagaatttacaatttaaatcaaactttgactcatttaattaagtctttagtcctgtgaacctcattcacagccttagcattgggctgctctaggactccaattgataaacttcttaatttcctgggtgtctgggttttttttcctttaaaaaaaaaaaaaacaacccatacatcaaatccaaactgttgaataaactacaaggaaatagtagccagcagcgaatgtttatatgttccagggtaatagataatgaataataagggactgagggtgagggtagacttaacaaaatgcttggaaaagcccaggtgagcttcaatctgtccacttgggaaataagtctgaagaaggagaactgcattccaattaacatctgtaatttgcattgtatgaaagcactagaaaataatagttttgagagcttttttaatgtttccagaggtaggagtacagataatcttatttaagaagcaagcataataggtctttctgtcatttctgagctgctgaatcataggaaggacaggaaactctacctcaagtcatgagaagaaaaggtctgcatgtgtctccttagccttaacccccttgcctaggacagaaagcggctgaaggagggctctgcctcaagtgtttcttaatcattcccttcagcaatggtgctgcttttgttacatgactgctaaaagagctgacgtgtctgtattgtgtactgggcaccattttacatacattgactcatctgctccttaaaaccatgctatggtttaagtattattacaatatttactagaaaattaaataacttgtagaaactcatgacccaaatttttaaaccttattttagattcttctaagaccagggcaattgtgaaaactcagtgttacccataaataaaacagcggggcactctccttatcaggaggcagtgtgccttaaaatcagctttgaagtcaagccagacttagctgcaagtcccccctccatcactgcaggctgcatgcctttgggcaggtcacttcagccttccgagcctcaggttccaagtctgtaaaatgggttagcatcattcccatctggcaggattgtcatggggcttaaatgagataacacattaaaagtgttcaggcctcagcctggatgttagcccaggtctcgcaaatacaagaccagccaccttcctcttcctcatccttaatgcttcctaatattctctctcacctcccacactagcagcgccattgcaggaactgtccccgtcccactgcactggctggcccagtgccacatactgcagggaggagacacaagcatgcggccctggggagcgctggtctctgcacaaacacggctcttgcagctttcaccctgagctcgccctgcgccagggcagccagtcatcttgacaagagcaaggaccgagttataggtcaaggtaagtggcagaagcaactcactttgatctgtaactagagctcagggagtcccattcgaccctgcaaggggcctgacaagcacaagccccacccaggagccaatgtgtctccgcagtgcttgctctagaggaggagggactgggcgaggtggggggaggagcagcctttggttcagaagcaaaatagggggaaaaaagaggcccagaaagaaacagagaggggagaagaagcgctgttaagtgacagagccacaaacagagctctcttgtctactgaagtgatgtaggggaactgaggtggcattggagatatgcctcccacagtgagaaagattgtactgggaagagatggagagaaaggtgcccctgagggaagaaggtaagccggacactgagacaagaaaccaggaaggctgagggagcgcctggagctgggatgggctcactccaggtatacaatgtgcacgtggggataaggctgcactaagtcgggggtcacggctagtaataataagcaaatcactgggaattactctctgggtaggcacaagtgaggcctctcaaaccaccctgacgttcagggtgagggctggagctctctgctcctgacagggagcacagcactgcatcctcgcagcccaggaaagttctggcccattcgaggaggtagccgggggtcccactgactctggaatgcttggggctctattttagtccttggaaccccaggagagtcagatccctcgtctgcaaagctctagatatccctgtcccttgatttttcttgaatcaggaatgtcctctaatttcagaaattaatttgaacaatttaaagccttctgggattcagaggaggcagcttggatgctacgtggagctacaggaggggcgcagccaatcagccactgatcttcactcctcaggaacacacggaaaaaagtccactgagcaaatcagaaggcacatacccgtgtgcaaatacacaaaatgtatcctattataaaattttattagcagtgacagttttaagggagctttagcaatatttcaagctctggcatcaaaatctgacatattcaattttgcttttatcaggttatctgatgacatttctgcaaaagaggcactcgcccatctcaggctcgcccctcctctgctgggcaacacttgcctacagttggcggagccagcatggacagcatctctcttcttctgctgaggaacaaacaagggttcaaccctcaacacacaaagaccaccagcactgcttgccctttcattttatagcaagctcatgtctaaagaaacccgtaggctcgtgggcaggggaccaaatggcaagtgcagatagtgtcattacagaggactggtgagctctgcagatggcatctggggcatcacaggtgacaggcaggctgttgtggggccctgcgtgtttgtgcattattgcaaagaccgggaatcagcagctaaagtgcatctacctggttagggggcagcctgccctggacagctgagagctgggaaagccatctcgaagattgccacatcacaggagaaaagccccatccattccgctctttctttttaacaagttcaggggtacatgtgcaggatgtgcaggtttgttacataggtaaatgtggtcatgggggtttgttgtacagatgatttcatcaccaggcattaagcctagtacgtgtcagttatgatttctgagcctctccctcctcccaccctccaccttctgccaggccccagtgcctgtttttcccctccagtgtatgtgtccatgtgttctcaccatttagccctcacttataagtgagaaaatgtggtatttggttttctgtccctgttttagtttgctaaggataatggcctccagctccacccatgtccctgcaagggaaatggtctcattcttttttttggctacatggtattccacatggtatatacgtaccacattttagaaatgcaaatcaaaaccacaatgagataccatctcacactggtcagaatggctattattaaaaagtcaaaaaaaaacagatgctggtgagactatggagaaaaaggaatgcttatacactgctgatgggattgtaaaaaaagttcagccactgtggaagacagtgtgatgattcctcaaagacctaaaggcagaaataccatttgacccagcaatcccattactgtgtgtataccaaaaggaatataaatctttctatgacaaagacacatgcatatgtttgttgcaacagtattcacaaagcaaagccatggaatcaatttttcttaataaatgaatccaggaacaaaagagaaggctccatgaaacccattaggtgcacagcaagagggtgaggaggttaagagggaatgagcatatctcctaatgacagagtctctccttgacccaacgttagtcaggctcttctgaatcctcttcctatctgccatgacttttaggctttctttttccttttttttttttttgagacagggtctcactctgttgcccaggctggagtgcactggcgtaatctctgctcacagtaaactccactacccaggttcaagctattcttgtgcctcagcctcctgagtagctgggattacaggcgtgtgccaccacgcccagctaatttttgtatttttattagagatggggtttcaccatgttggccaggctggtctcgaactcctgacctcaggtgatctgcccacctcggcctcccaaagtgctgggattacagatgtgagccaccacgcctggcccacttttagactttcttatccatctttgcatccctcaattttagcaagatctggctaagttggtttaccttcaatatctgatcacccttgatataagattggtttcttcattccctgccatcttccaggtgacatctgatcacctcggcctgcctacagcaagaatcctattggcaaataattactttgccttctgagtaattttctatccaacaacccccaaccactctgtctcatcctgctcttggactacaaatccccaatttttccttattgtatttggagttgagtccaatctccttcccctgctgcaaaaccccattgcagtaatcccctccaaataaagcctgccttactgttctttaacaagtgccaggaataatttttaagcactaacccaaatttctttcctgtactccttacaacaagatgtaaggagcacactcggcttgtcctcaggttgcatttattaaacaaaagctaaaatccccctttcaaatatgagaacataaagcatataagagagaagtgtttcctgggtgatccaaattaaaaataagagccatgggccaggtgtggtggctcactcctgtaatcccagcactttgggaggccaaggcaggcacacttaagttcaggagttcaagaccatagtgaaacctcgtctttactaaaaatacaaaatttagctaggcacctgtaatcccagctacttgggaggctgaggcaggaggatcacttgaatctgggaggcaaaggttgcagtgagtggagatggcaccactgcactccagcctgggcaacagaatgagactctaaaaaaaaaaaaaaaatagccatgggcaagagagacatgtccttgctgatttctccccttgaatctggcccactgaggacacctcttccttctcttttttttctttttctttttttgagacagagtctcgctctgtcacccaggctggagtgcaatggcacgatctcagctcactgcaaccaccacttccagggttcacacgattctcctgcctcagcctcacaagtaggtgggattacaggtgcctgccaccatgcctggctaattgagatgggttttcactatgttggccagactggtctcaaactcctgacctcgtgatctgccctcctcggcctcccaaagtgctgggattacaggcgtgagccactgcaccccgcctcttccttctctttattctgcctgaggatgcacgttctcttttgacagtttcagcggattgaggctgaatgttaagttttctgccaaaatgggttcagtatcttgtcagctatttcctctgctgaaacgaactttcatctttaatctactcaggagtgctatgtatgacaggcgatccttggaggagagaagtctgagggacagcctgctactgtatttaaattggcttcacccagacagataaatacaaagataaggttaataagggttaataatttatagtcagaaaagtttaagaggattgcataatttaagcctcccgtgaaggccccaaaccaaactctatattattatcctgaagccgggtctactccgtgactctccttctgaataacagcccctcatgagtctcccagatacctgacctcaaaaccacagagccactgaagccaccttctgtctccttctccatcttctctgagagacagctggttaatcaggtcaaattattcttatctgattattagtcattagcagttatagttattctctagtaccttccacatttgttcttatttttattctcacttggatacttaagaataaaattcttctgcttattttgtttgaatccgtggattttaagaattattcctggctgggcgcagtggctcacgcctataatcccagcactttgagaggccaaggaggggagattacttaaggtcaggagtttgagaccaatctggccaacatggtgaaaccccatctctactaaaaatacaaaaaggaattagataggcatggtggcgggcacctgtaatcccagctacttaggaggctgaggtagaaaaattgcttgaacctgggaggcggaggttagagtgagctgaaattgtgtcactgcactgcagcctgggcaacagagcaagcctccatctctaaataaattcattcattcattcatgcattcattcattccatagtacagctacgatcatgttggtgccccattcaaactcagtttgcatcgagggtgaatctccctcccctccctaggatccctgttgggatctctggagatggtaacctgcgtggaaggctccaggctctggtcctcaccctctctgtgaattccacttgaaagcctttctgcctacgtgaagatgcagatgaaggacccgaggcttaaggcaacaagaaaatttagaatagttagcagccgagataatgaataagaattttcagtaacttctgggcaacataaaagtggagtgctcagtctgcaatttttgccccatcacctttaataagcatgaagcaaaatgaacaaaaagaatattaaacttttaaagactaaaagatctttcaaaatatattcctcgcttataatggtggcaatgaccctttccctttgttacctagctgaaaaaaaattacaaagtcgcatcaaaagcagaaatgaacattgcagaatgggagtagaatagtttgcctccaaggaaagtgattgaaagttgattatccggtttgttaaacagctaacattgaaccctgtggtcgggttttgggtgaagactctaagcctgaaaggccatggtcagggtctctctacggagctggacggttggactttctgctgtcgtggcaatgttctgtatctactctgtccatatcctggctactggctgcatgtggctgttgaaccacaactgaggaactgagtttttgttttattgaattttaattaatttttaaggctaatttaaagagctacatgctgctagaagctaccacattggacagcacagaataaggcattcatgctgctccacctttccccgattcttgttcacaaggtcagaggttgaggaaatgtcaatgcaaaacagaagggggtataaggcagcaggacagaccctccacccccaccccggaagcagaatcacacgcttcgcttcaggcctgcctgcctcctggtgtgcaatgctgatgtcagccgtggagttggcgtatgtgttctgtggaatatctcataagttaaggagtctataattagtactgggaatctaaataataatcatgataacaagaactaaccttgatagagcgtttactaatagaaagtcctttacacaggtacaaaccagttgggtagctttatgtaaatgagcgggacagaggcctagaaaattcaaacagcttggccaagaccataagattaataagtggtagagtcagaacttgaacctacttctctctgactgaaaatcaatcaactcttaaacagtaaacatttaaagtgggattgtggctcagctgctcaaccagtggaccaaacaactaattctctgagaccctgggccaccagtagatgcccaggacagcaagagcccctggccagtagcctctaggctggtggcgtctgtccagaagcagcagtatctctccaccacagtgtgccctacaaatatcatcactgtcttcacgtggaacgaggaaaaaatgtctaggaagcactgaacgacattctaaggaaaaccatgtgggtcattcccaaagagctggtcatgaacaagaccccaaggatgctagcacaccatttgactgactccaagaacagtattggaggcaggaaaatgtcctcacgtgccacaagattttaaattctaatttgcagtagaaggaattataaataggacaaagtcagaaatcaccccaatttttgcatagccagggtcggttaaattcatgaataatgatgagaaaatgaagaccctaggattaaagtggtagcttagtttccgtaaagacattaaagatatatacatctcagtaaagaagcttcctaacactgtcattctcagacaatggtcaaatcaggtgtttccacatggcttcttagagcaaagtttcttcaggacaatgggacatttgtaaaagagacccaagctttgatctgatccatgacagggaggctgctggtattcactgagtctgtcgccacatcaacctggtgaaggcttgggcagcacctgtcaatccgacacgaagaggtgttccatgagtttaatggacaccgtgtgccaactccattttaggttattaatatcaattggagggaaaagaggaaaacggggagagattgctcaatagtggattttaaaagtcttttgttgcatcttgctgaatttggtcccaacttccctcatctaacaaaagataaaaataggctccaaggctgttatgctgagagttaacatgagggaggacttatccctcattttcttgatatctatcccatgtgaagagaagttttgtaactgtgaaatgatatctaatgcgggttctaatatagaaacatatttcttccaatgtctcacactccctttcattcgagcgaccaagtcctgctcacatataattttattagaacttttctcaagggttactattaatactcagaataccaataacaactataatgtatttaccacataccaggtaataggctattttacatagattatcttagaatttccctaaagcccttgaaagataattattatgctctttatgcaacagatttgttcactcattcattcaacgcatatttattgagcacctgcccaacagcagtgggcatttcttacccgttgctgttgggagcacagggcccaagcaggctccctgtccccagtgaggaaaatacaggtatatccaaaggattacatcatagttcttacataaaattattctgttaccatatgctcacatgacaatactgcttctttacaaaatggtatctgcgtgagtgaaaaacaattcagggtgggtgggtgggagactcgggtcttgtgtctccagatttgggtcccaccttaccaaattccatcatgtagaaaaagaaaattcctcaatgtaattgctcctgtgttgatataattgatatccttccagaggaggaaaacctagtttttaatctattttgcattgttcaccttctcagcaccacatacttagaataagcaggaatgatggctctatcactgtaccatgaggagatgagactatggatgctgtgccagggtctgtaagacttttaaacaagagctttgtttgattccattattaatctcatcagagagaggcccaaaagtcatttaagatttggttactgggccaggcacggtggctcacacctgcaatcccagcactgtgggaggccggggtgggcagatcaagaggtcaagagatcgagatcatcctggccaacatggtgaaaccccgtctctactaaaaatacaaaaattagccgggtgtggtggcgggtgcctgtagtcccagctacttgggaggctgaggcaggagaattgcttgaaccagggagttggaggttgcagtgagcggagatggcgccactgtagtccagcctggtgacagagcaagactctgtctaaaaaaaaaaaaatttgttactgaatgtgggtttgaatgggttaaaaagctggcacagaaatgcaaaaaactaccgattttctctaaggagactatcagaagaaatgcaactttgtcctgccttgcccaagggcagagaaggttgcagacatcctctcccctcctcagctgtctacatcaagtggttgaggggtgggtattttgtggcatgaataagaggattattgtgcagcaaacacttgatttctaagcattttacctgtacttttttagattttagtctttgcctttttttttttcctatttgtttcccacttagtaccttagaatttgcctttttaatgcaaaattagcatagtaaaaaaattgaatccggggtgcatcacttagaaaagttaaagaagattttcaaaattaattgttgacaagactcagcaaatatttgctgaatacctgttatgtgccaggtaatgtcataaaccctaggcataggactgggaaccaggtcctctcttcttggaattcacattctatttcacaagggttgggaaagaggaagaaatacagaatggaaactctgccctgagcacaaaacctgtgcatttggttagaagaaggctggtgctctgcacacaggggcctaagagaggaatatgaggtagtggagctctcagtgacctcgctgttagagctgtagggaagatttaggtcaccgccttatcttacaagtgaggaaactgataccaaaagagactggaattattgtctgaggtcacccaggctgtcccactggatgtcaggtaccgcctcttcaggactattcattagcatttgtgaaagtcaagatataacagcatatttcgccttatttctttcttttcctctttatgttgtatttttctttttgggtcattgttttgcattaatgttcatagacaatttttcaccatttatgtaggattagttctcattgaaatattaattccacattttcaataatttatatgatttgatgtcacaaatatctggataatttgatatagcatcaaaaaaaggctttctctaccttcatgtattatcatataatgcattttcttatcatagggaaatcaaaatgtgtctctctaattccttttggttttttaaattttatgagtttaacatgcgtgatatataaatcacagtcaaacattttcttcttacctcatctgatttcgtttgataaaatcaactccatctatatgtatgtcttttagaaatacgtctcagtttttcccaaatgggtatgtcttacatctaatgcgtgagaaaaaattccagtagcacctccctggggaatctgaactaggccctggttatgctaatagaagccaagaggttttcaaagcaaaagaactataataaattattcataaataggtctctctcttgatggttttggtgtttccgaattttccagaccatagaggatatgtgaaacgatacatgcacgctaagctgaagatgttacagagggaaatgggaattgaaaactaattggaattttaaagcattgcatttttgcatttggtacactttctggagctggtttgggcatggacaagacccaggagcctgcttttctggtggtccttggtgactacggatatttttaacaggcagggactggtttctgaggaaagtgtgtcccagttcccaaaggaaaatgactcctcagtgactgttagccctcgaggcagttccagatgaggtgctagacttaattcaggttgccagtctacagaaatgaagactttacttggcatactgctcgtttgcacttggtttgtcagactctctacctcctcttccttctttttcttaaacttgtttttcagtttgttcctctgggtctctacattgccaaacccaagggcacctcctagtctgcgtgacggacccccacgcctggtccagtccacaggtgccatggttttgttgtacctgccaacatttcaactgttttagaattcttttttgtcttaatgggtgttgacaggttttaaaatgtttcctgcttatttctacttgcaattttctgatctctgtaatttaaactaattgcatctactttgttatttattccattttttgtactcatttaatagaaaaaataataatttcttcaacttcagtcttttgtgtttgccgaaacccaccctggcctcacatgttcaagttaagccctgcccccaccttcctcacactcccatagggtcacagaccatgcactgatttacctgcctttaggagcccccaaactccttccttttgagatttttctttgtaatgaatgtcctcgccatgatcacaacccaaataaaaactcttcagtcgtctgctgtattttgtctttaacagtgaacagaattcaattcgaattttgggttcacatttagtcttataatttaagaaagaataggaaaaaacggagagcaacttgatttgaaaaagacaaatctgaggcgggtgagagattctaagtcctgatgtgcttggaacagtccagacctctgtcaattgtcccagcaaaattattaccagcacccccttttacactcagaagatcctggtctagatgaagaatcatatgtgcgtcagctattttcgctaccgtaaagcccagcccagcacagtcccaaggatagagtaagcagccaatatacatttactgagttaggaataaaaagatgccagcggtcaccctccttccctcatggtgggagccagggaagctgacgctactacaaagctatggcgtcacaggtactggacactggctagtcacatatttatatgactcctggaagacagccatgagtagatggctattatccatattttaataatatctgctaagaaaaataacaattttgagatagcacttgtggaatgagtcctccatatttaatgaaccagggaaacataagggaaaggttaaacaattctatgaagccaggcgcggcagctgacgcctataatcccagcactttggaaggctgaggtgcgtggatcacgaggtcaagagatagagaccatcctggccaacatggtgaaacctcatctctactaaaaatacaaaaattagctgggtgtggtggcgcggctgtagtcccggctacttgggaggctgaggcaggagaatcgcttgaacccgggaggcagaggttgcagtgagctgagattgcaccactgcactccagcctggtgacagagcgagactacgtctcaaaaaaaaaaaaaaaaaaaactctacaaaataggagaaatatctaaaagtttttttcttgtttgtctttatgaagggcttcttcccgttcagtaataatttcccttgcaatggagcaaaacttgagacaataagggactcaggaatgtgttgaaagctcatgaggaatttagtctaattccttcattgtgagttgctggcattctactccatttgcattcagcctcctgttaccaccaatgctccccatcagtaacagtcatactaatgtggggtggaatgagaaactctcagtgcttccaatgctataaccacttgcctatcccagtttccaatctcctttaaatactggggatgttaaaggtaactgagtttatgccttggattgtctgtgaaatcgtaggaaaatacatgtgatcttccaatgccccagtacttacaaataacgatactttattgccatggatttaacgtgtcctccaaagttcctaagttggacacttaatccctgatgcaacaatgttgagagatgggacctttaagaggtgattaggttatgagggctctgctctcatgaatggattaatgtcgttctcatgggagtgagttccttatcaaaggatgcatttggcccatttctctttctctttctctctctctctcagtctcttgcccatgtgatgtcttcaccatgttatgaatcagtaggaagaccctcaccagatgcaggccccatgatcttggacttccagactccagaactatgagccaaataagtttctgttaattataaattgcctagtctgtggtattctattatagcagcacaaaagagaataagccgattactatattatgtttcagaagcttttcaagaatcactcttatattatgcacaaataatgtgttttgtttgttttttttttgagacagagtctcactctgttgtccaggctggaatgcagtggcgtgatctcagctcactgcaatctcggcctgatgggctcaagtgattctcgtacgtgcctcagcctcctgagcagctgggaccacaggctcccaccaccatgcctggctaatttttgtatttttggtagagacagggtttcaccctgttggccagtctggtctcgaactcctgacctcaggtgatccacccgctgaagtcctgggattacaggtgtgagtcaccgcacctggcccaaataacgtgtttttaatagttactgtgggccaggtgcagtggctcacgcctgtaatcccagcacttttggaggccgaggcgggcggatcacctgaggtcaggagtttgagaccagcctggccaacatggcgaaaacatatctctaccaaaaatacaaaaattagccgggcgtggtagcacacacctgtggtcccagctgctcaagaggctgaggcaggagaatctcttgaacctgggagacagaggttgcagtgagctgagattgtgccactgcactccagcctgggtgacagagcaggactccgtctcaaaaaaaaaaaaaaaattaattgttactgtgaggaagatgatagccacagagggaattttttaaataaacaacctttcaacaggaagacagagaagaaatataaaacacaatcacatgggaggctgagatgggaggatcccttgaggccaggagtttgagaccagcctggacaacatagtgagactccatctctacaaaaaacaaacaaagaaacaaaatgagccaggtggtggtgcaagcctatagtcttagctactcgggagttggaggcgggaggatcacttgaacccaagagtttgaggctgcaatgagctatgatcacatcactgcactccagcgcgggtgacaaagcaaggctctgtctctaaaccacacactcagacacatatgccatcacacacacacaatcacaaagcatcagtcaggaaggccagcaagagcagaacacagaatgttaggatttcaaggtagaagctcaacactcaattcaaggtaaacttgataagaatttgcaacaagaccaatgatctgctaggtattataatgaatagaaaagcaatatggggttctggctgtaaagcaactgagcttttttgaagaaacattaaatgcacacataaaacccctgaatgtatgtcagcagatgacgaatggctctaaagtggtatggaataaaaaggaaaaatcatgaaaaaagaaggcccaccaaattggaacatctacttggaaaacttgagaaagaacagttttggttgggagtcaagtgcagttaacaggattcagagtgagcaccgcgtgggcctctgaggtcagaaaccagagggaggccagagaaatgagatgagctacaaagtgcctcaggaaagagacagctgggaccagatgacacacacaccatggcctgtttttatgttttatgtcagttttaagagacactgggattttcctaaaacaatatatatttgatggaaaagtgctgtccatttcagtagcaaaatcactttattatattgctgggaaaacttgagaactgaaagttggaagacagcaggtggaggttataaatttgatattaatatggcaatatggagtgagatttatgggctctgatagaatgtgatcttttactgaaaactgtttttactttcttatatgtatctcagtgatttgaccctggttttatgtgaatattgttttaggggatgtagttttctgaatacaatttattttattcaaatgactgcttacggatagatagctatggactagtgcggctacagtttcaataaacagtccaataacattggaagataagttttgaaagactgtaagaagccaaagaataagtttagacaattacatatttggatataattgcttttgaagtcaatattcaattttaaactgtttaagataatatgtttttgcttttatctaaagtatatgagagacttacaccaagcactaaactgaaattgtggtatgcaacatgactctacttaacagagctaggaatactgtcagtttgcaaaggtaaaattacttcgactttttctctggaaaactgaaatgaattcctttggaaattaaagtcctcgttgctttacaaacatcatttcattatgcaggagatctttactcacaaacattcatatcacacaatgtcagaaacacgacaaggagagaaggcatggggctgtggtcaacccacaaaagacaggcttttatccccagctctaagaatttcccacagacattactaacccatcatgcccattcagtgcacacagagtgacaaggtttcaagtggcgctgcagtgagagactactatgacaacgaacacaaaagaacagacattttaaaacactaaaaattggcccggtatggtggctcatgcctgtaatcccaacacttcgggagaccaaggcaggtggatcacttgaggtcaggagttcgaaaccagcctggccatcatggtgaaaccctgtttctacataaaaaaaaaaaaaaaaaaaaattagccaggcatagtggcaggcacctgtaatcccagctacccaggaagccaaggcaggagaatcgcttgaacctgagaggtggaagttgcagtgagccgagatcacgctgttgcattctagcctgggtgacagagcaagattccatatcaaaaacaaacatacaaacaaacaaaaaacaaaccactaaaaattaaatgaaaattaagattaaaaaatattaaaaataaaaaataacagaaaaaaattaactgaaaattcgaaatgcatatgtgatgaaatgttaggcaggaagaatcagcaggagggacaaccgccaaaaatgaaagctgcaaaaagtaattttttctgtctattcaacccacaatcatcacaggctatatttgaaaagtaggtaggtgtacttacctacatatagctgtttgtaggttatatttgaaaagtaggtaaggtgtacttacctacatataactgcacttacatacagttatacatatacctacatctaatgtagttatggttttttaagagagtaaagaataaaatggaagactaccattactgacagtcttctaaaaggcagtcaccatagcatgattaatttattcctggtgttctcttggtcctcacatacttgattctcttgaaaccagtgaaaaactcgcatgtcttactgctagatctagaaaagtggttctcggccgggcgcggtggctcatgcctgtaatcccagcagtctgggaggccgaggcgggtggatcatgaggttaggagttcaagacaagcctggccaacacagtgaaacactgtctctaccaaaaatataaaaattcgctgggcagggtggtgtgtgcctgtagtcccagctactgaggaggctgaggcaggagaattccttgaacccaggaggtggaggttgcagtgagccgagatcatgccactgcactccagcttgggcaacagagtgagacttcatctcaaaaaaaaaaaaaaaagaaaaaaaaaaagaaaaagaaaagtggttctcacaatgcacaccttgcaccagaaccacctggagaactttgtaaaaatgcagctgcttgctcaccacccccagaacctctttctgcgatgatcagggtggggttttgggcactgatatttgtaagatctgcatcaagtgattctaacatgctgccagttaagaaacactggttaacaaggagacacatatgaaacctcatatatcagacatctaacctacccttatttcttttattctcaaatctccatctcagctttcttcttcatttagaatttggatataaaccgtaactattaaaattgactgaatatatctaaaaatcattgattcatttacttattgcacacatacataatccaccattcatctgatgagatcacagcatttagaagagtactccaaacacaggctgctaaatcctcatctgttgattgggtctttaaaacattactattgttcactttcatactgacaacaatgttatgctatagggtaagctcaaatttaattttctttctttacgctgttctttattgtattttttccattaaaataatatttgacagataatccttatacctgttgcttcaaataataaaaataacctaacttattttatgagactaatatcttgttacccaactggataagaacaatgtaagaaaagaaaattacaggccaattttacataaggctatagatataaaaatccttcgtaaatattatctaacataagaaagtgtacagttaaaaaagcagaatcaagcagggttcatcccaaggatttaagaatagtttaacatcagaaaatctatgtatgtagttcatcaggttaacagactagaggagaaacttttcatgctacttagatgctaggaaagcatgagtccaagcacagggtctctgtctctctgcctcaataattctccagattacgatcaaagatctgctaggtgcggtggctcacgcctgtaaacccagcactttgggaggccgaggtgggcagatcacctgaggtcaggagttcaagaccagcctggtcaacacggtgaaacccagtctctactaaaaatacaaaaattagccaggcatgagggcgggcacctgtaatcccagctgctcgggaagctgaggcaggagaatcatttgaacccgggaggcggaggttgcagcgagccgagattgcgccactgcactccagcctggtcaatgagagtgaaatgccatctcaaaataaataaataaataaataaataagattgaaaatgaactgcttcttctacagagcttctgtaggatgaaaaaaaggcgctgatatatgctttctgtaatttgactcaatgggtttttgaatccttcatataaatttataacatcatatttcatttattagaaggtacatatactgtttttttagtagcacatttttaccataaatggtgactgtaatcgataaaacagagtattcaatatatttctacaaatgtgtattcccttctccccagagaacatcatagtataaggtgatctccagttttcttctgattctatgatttaaaaatcatccctgttctgaagctcttaagtattttgtttcttttaggtgcattggaacaccaaaatcactcatctgtttctttattcttgcttcccgctactcaagaacataaaataaaagctctcaagtactaaaatactgggctttatataaactagagtttatataaatactgaaaaatatttcttcctagaggtcagactgtcttcagggtcatggctaacataagcatttgcttagataaaaagttgacatttttttctgtaaagaatcagagagtagtcctggcacagtactttgggaggctgaggcaggtggatcacctgaggtcaggagttcaagaccagcctggccaacgtggtaaaaccccatctctacaaaaatacaaaaattagctgggcatgatggtgggtgcctgtaatcccagctactcgggaggctgaggcaggtgaatcgcttgagcccgggaggcagaagttgcagtgagccaagatcgaaccacggaactccagcctgggcgacagagtgagactccgcctcaaaaaataagaagaatcagagagtaagtgttttggctttgtaaaccatacatcctctatcagaacggctcaactctaccactgcggtgtgaaagcagccacagacaatgcatatgagtagggttgcatttcaatacaactttacttacaaaacaggtggtgggctgcatttggtgcatggatcctagtttgctgacacctggcttagatgcagtgcacccactgaggaacaggtgtgtcctactctgaaagcagcatgagctagtctgactacttatttcaaatcaatactatattttttaaatggcccacattttcaatctagcaaatctacattggggtatgtgtatgggtgtgcccatatgtctgtatctgttaaatgtatcagtttgcttttaaaatgttgagacacagctcacataagcagaatatcagttcaaagcagttctggccaactcagtttaaaaaataacaacattggtgtgttactaatactaccatttctatacgtagcatgatttctcctctctggtttaataacagtcatccaagtgtgacttcaagtaatgatcacttccagtgagctcgagtttactgctaaggtgtgaggttggaaagaggaagacacaacttcatggagatcaaatcactcatgaccttaacagccaaataagtattaaatggctgcaaggtaacaggtaggcaaggtttgttgtagcatccaattatcacgttggtgcaaagacactcagtagacaacaagtatctaatggccaaggagctgaaacttatgaattggctgtttaaaaaatatatttgccataattccttctcacacctaagtttcccaaaaggaatgcataaagcaggtactaataatggaacaaaaataataaagtgcttgccagggtagttgattccttttgaaaactgatcacaagtaagagattttagttacagctttcttttgcttcaatgatttgctaagaatccataaggataacctattcagatactattatcacatgagacatgatatgtgaagcaaaaactgttacgggaatttctgcttgcatgtacactggctgttaggttacagaatagaaataggattcctctgcatatttaacattggttctccatttgtagccggacaaccagatagtactgatttcaaagtcactgttaaaaactctaaaaacttagatttcggtaacatgtcatcacattgcacgaaaactggacctgccactaggcttggagaagctctgatgtgctataaacagccctaaccatcaagatggtaaaggctagtgtgacccagagacttctgctctctgaatacccacccccaccttcacctattccctttataaatgctaacagagcccgggaactttctgttccagagtgagcctgcaacagcattctcttgggtgaaatgctcttcccgttggcggtgagaatccttcctccttattctaacccatgctccccacagaggaggaggaaccctgagcttctcttagggaccatggcagagggttggaggcatggaggcagctctgcatggccttttaatgcttagtatgctcagggtgccgcctttcaattaactagcacagctgtacttttttttttttttttttttgagacagaggctcgctcttgttgcctaggctggagcacagtggcgtgatcttggctcactgcaacctccgtctcctgggttcaagcgattctcctattctcctgcctcggcctcccgagtagctgggattacaggtgcccaccaacatacccagctaatttttgtatttttattagagatggggtttcaccatgttggccaggctggtctcgaactcctgacctcaagtgatccaccacctcggccttccaaagtgctgggattacaggcataagccaccacacaaggccacagcgatactttttgactaagtaaggcttccgtaagagttttcacacacatgccccaaatcctggattatatgagacaaaaataaataggccacgtgtgctaattgcgtacctctctcttctcacatttcggttttctagaaatgagaacgcaggccagacgcggtgactgacgcctgtaatcccagcactttgggaggccaaggcgggtggatcacaaggtcaggagatcgagaccatcctggccaacatgctgaaactccatctctactaaaaatacaaaaataagctgggcatggtggcgcatgcctgtatgcctgtaatctcagctactcgggaggatgtggcagaagaattgcttgaatcagggagttggaggtttcagtgagttgagatcatgccagtgtactccagcctgggtgacagagtgagactctctctcaaaaaaaaaaaaaaaaaaagagaaagagcatttcttgtatgtcttgtgacaagagttaacaaaaacagtcctgcttcttaactgttggtgacatttgtaaaggtcccatggttatgcttattcagtgggattccgtcttcttgcatgtctaatggtgttagaaggcctgaaactatgcctaaaactatggttttatcccagagagaaaaataaattcatatcaagaaaaatactaagatttatatataaagcaacaataatggcaataataattctatggtgtaattcccctgagaaaaactgaacggaacaatggttaatcttaaaatattctacagtagagctcaggacttagtataattgcctgctactagtctcgtgataacagtcgaagctagttttgtggagggtttttttgacacttcaaaattatcatgttgtcttcaaggtcacaaatcaaagtctcatctattagtgtataatagtaagtttacagttttaaaatattttatcattaagaaaatattaactgcaaatttaaaaaaagtactaagtggaagtaagcgaaaagacagatattgtgatgaaaagaaagaccttctttccctgcctttttgagtgtattgattcattcatttaactgatacttgttgagtgtctcctttgttgtggtccttctgtgaagcacctccattcaacagaccctttctttgggtaagtgtgtataagtttcaacaagggaaatccatgtatgcatgcaattgtagagactaggacacttggtgataaaggacttgaaaaggaaattaatatcccacttaaatcttctttttcaacatcagattttacaatatttgcgatctcgcactcactttttctaaaacaactcattggacaccgttgcctcatcacagccctaaaacagaactccctctttcggtcagtaacaccatcatcttcctagttttaaaaccttggagtctgttttttttcttgtaaatttgttgaagttccttgtagattctggatattagacttttgtcaggtgggtagattgcaaaaattatctcccattctgtaggttgcctgttcactctgattatagtttcttgtgctgtgcagaagctctttagttcaaccccatcaaaagaggacaaaggatatgaagagacacttctcaaaagaagacatttatgtgaccaacaaacgtataaacaaaagctcatcatcactggtcattagagaaatgcaaatcaaaaccacaatgagataccatcttacaccagtcagaatggcgattattaaaaagtcaggaaacaacagatgctggcaaagctgtggagaaaaaggaatgctcttacactgttggtgggagtgtaaattagttcagccattgtggaagacagtgtggcgattcctcaatcatctagaaccagaaataccatttgacctggtaatcccattactgggtatatgcccaaaggattataaatcattctactataaagacacatgcacacgtacgtttattgcagcagtatttacaatagcaaagaaccatcccaaatgcccatcaatgatagactggttaaagaaaatgtggcacatatacaccatggaatactatgcagccataaaaaaggatgagtttgtgtcctttgcagggacatggatgaaactggaaagccatcattctcagcaaactaacacaggaacagaaaaccaaacaatgcatgttctcactcataaatgggagttgaacaatgagaacacatggacacagggaggggaacttcacacaccagggcctgttgggcaatggggggtaaaggcagggagagcattagaacaaatacgtaatgcatgtggggcttataacctagatgatgggttgaggggtgcagcaaaccaccatggcaaatgtatacctatgtaacaaacctgcacgttctgcacatgtatcccagaacttaaaagtaaaatttttttaaaaagtataaacattcaaaaaaaaaaaaaaaaaccttagagtcgtcagttgcacccctttttcttctccctcatatgcagataatccccaaatcctaccaactgtcccttgaaatgtctcacaatctgttttttccattcaactaagatataaatgtgaggtatctttcaaaaacctgatagtaattgaaaaatattctaagaacttccacttgagctgatattgaagctgggtgactagatttgtttcctgtcacttcctcaactaatgatcacaaacttgctgccttaatataacagaaatttatctcctatcaaggggaggccagaagtctaacacgactgtgcttgctctgaagagtctatgggagaatatattctttgcctctttcagtttctggtggctgccctggcattcctggatttgggccacatcactgcaatctttgcctctgtcttcatatcttctcttctaaggacatttgttattggatttagggcccacccagataatccaggatgactgactcaaatcaagagccttaatttatctgcaaagacgctttttccacatatggtcatattcacaggttccaaggatgcagacacatgattttggaagccactattcaacccactacagtgaattagttcctccctttccctgaaatgaatgcacaagtctcctagccttttttgagtcaggcttgtcggggattactcgaataggaaattccctaaattgttctagccttggcaactctaagtgggagcagagagagtaaggctggtggtgaaagcagttttccttcctactgcaactttattcacctctgcattggctgagcttaacataatggaaggttaaatacagaaataaatgaatgaataagtgaataggcacaggaatgaaggagtaattaatgaatggactaaagaccaaagggatctcaagagtataaattcccatgagctcccctactgtgaccccagcctggagtaacggggtaaaaaaaaaagattccttttggtctactgagcctgtggaagagagaggaatgaaccaccatggctgtgaggtccagctacaaatgggaggtttgtcccttagaatcaaaggctggtggcagcttcccttccattcagaggcgagaaggagtccaagccattcagaggtaagaaggagtccaagtcacacagaagcaacgaagacccgtctatctctgaagtggtcagaagtaaaagctatttcctgtttggtttgtttttttaagagaaagactatgatgtcagaggtacaagacaccatgatcatattgcaacagtcctaagatggtgacacatgtcagacaatcagatcttctcaaattcttaaaattattatccaggatgaactgattttcacctaaacataaagatcaagaagaatcaagctgcttttgtgttcatatgaacaacaaaatgtctcaaaataagcaaaacctcaattgaaagagaggcttgagattacaacgtgaaaactgtttcttgccattattctgttttgggatattcttctctataatgcatttatcactaaagaacattcaatttttgagacagaagaataacataaaagattattccacaagataaagaaaatgccactttgacacagacctctccttttctgtttgtcattcccttgactttgtaaaaaaggaaaaccatgttccttggatttattaaaaaaaaaaagggaaaaaacattctgtgttgttgtgtatacgtttttaaattatcaatctgctcaggactgacaaacatgaaaagaattaatttaatgccaaaaaatctgagaaataatttatgtttaacaagtatgcccccttattcctgtgtgtgtactgtacaacagtgtcctactcttaagaaaagtgagtttagaaagatatttgctcatgtggtttttcaaaattgagtatgacatttcctggaagtgatggtgaaggtaatctctgtatgacaattaacccagtcatcagcaccatacacctgggcaaggggctcaagaatgaaaatctctacacttcccgcctctactccaggtggaaagtcacagggtgggagggcaggcttgagatccaagagaagacttttaacactttaaggtatataggcatagctcatagctgtcatgggcttggttccagaccaccataataaagggaatactgcaataaagtgagtcccatgaatgttttggtttcccagtgcatataaaagccatgtttatactatgccatagtcatattaagtgtacaagagcattatgtctcaaaaaagtacataccttaatttaaaactattttattgctaaaaatgctaatgatcatctgagcattcagcagcttttaattttttgctggtagagggtcttgcctcaacgctgatggctgctgactgaccagggcagtggttgctgaagattggggtgactatagtggttccatacaataaaacgaagacaaagttggccccatcatttgactcctcctttcatgaaagatttctctgtagcatatggtgctatttgattatattttactcacggtagaattttttcaaaattggagtcaatcctctcaaaccctgctgctgcctcatcaactaagtgtatgtaatattctaaatcctttgttgtcatctcaacaatgttcacaccatcttcaccaggagtagattccatctcaagaagccactttctttgttcacccataagatgcgattcctcacctgttcaagtttgattatgagattacagcaattcagtcacatcttcaggctccacttctcatgctatttctcttgctatttccaccatatctgcagtcacttcctccactgaagtcttgaagctctgaaagtcatccatgagggttgaaaccaactttttcaaagctcctgttaatgttgatattttgtctttcacccatgaatcatgaatcgttttaatgacatctagaatggtgaattctttccaaaaggtgtttttgtttgtttgtttgtttttgttttagtttgttttgtttttttgagacagaatctcgcactgttgcctgggctggagtgcagtggcatgatctcaactcactgcaacctccacgtcccaagttcaagtgattctcctgccctagcctcctgagtagctgggattacagtcgcccaccacacctggctaattttttcgtatttttagtagagacggggtttcactatgttggccagagtggtctcaaactcctgaccttgtgatccgcctgccctggcctcacaaagtgctgggattacaggcgtgaaccatcgtgcccggcctccaaaaggttttcaatgtattttgcccagatccgtcagaggaatcactttgaaaatgtgtttttaaattgcaattcttagaagtcaaaaaaacttcttgatccatgggctgcagaatgggtgttgtgtcagcagggatgaaaacaacattcatgtccttgtacatctccatcagagcgcttgggtgaccaggtacattctcagtgagtagttatattttgaaaggaacccttctttctgagcagtagttttcaacaatgggcttaaaacattgagtaaaccatggtgtaaacagatgtactgtaatcccgactttgttgttccctttatagagcacaggcagagtcaacgtggcctaattcttaagggtcttaggattttaatggtaaatgagcatttgctcccacttaaagtcaccagctgcattagcccctaacaagggagtcagcctatccttggaagctttgaagccaggaatcgatttttttttatccaactatgaaagtcctagatggcatctttttacaacagaaggctgtttcatctgcactgacaatctattgtttaatgtagccagatacatcaaacatttaagctagatcttctggataacttgctgcttcaccttgaactttcatacgatgtagacggcttctttccttaaatctcatgaaccaacctctgctaacttcaaacttttctcatgcaactttctcacctctctcagccttcacagaattgaagagagttagggccttgctctggattaggttttggcttaagggagtgttgtggctggtttgatctatccagaccagagtttttccatatcagcgataaggctgtttcactttcttaacattcacgtgttcactggagtagcacttttaatttccttcaagagctttcactttgcattcacaacttggataacttattggagcaagaggcctagtttttggcctatctcagctttcaacgtcttcctcactaagcttaatcatctctaacttctgatttgaagtaagatgcaattttcctttcacttaaacactttgagcccattgtaaggttattattaataattggtcttatttcaatattgttgtatctctgggattagggaggcccaagggtggggagagagatgtggtgatgggcggtcactggagcagttggaacacacacatttatcaagtacgttcacaatcttatttgggcatggtttttggtactgcaaacaattgcaacagtaacctcaaagatcactgatcacaggtcaccataacagatataataataatgaaaaagttaaatattgtgaaaattaccaaaatgttggccaggcgcagtgactcacacctgtaatcccagcactttgggaggccaaggcgggtggatcacgaggtcaggagattgagaccatcctggccaacacagtgaaaccctgtctctactaaaaatacaaaaaattagccgggcgtggtggcgcatgcctgtagtcccagctacttgggaggctgaggcaggagaatgacatgaacccgggaggcggagcttgcagtgagctgagatcgcaccactgcactctagcctgggcgacagagtaatactctgtttaaaaaaagaaaagaaaagaaaagaaaattaccaaaatgtaacagagacacacaaatgagcacaggctgctggagaaatggcactgatggagtggctcagggcagggttgccacaaaccttcaatctgtaaaaatcacaatatctgccaagtgcgatacgatagacggcaataaaaccaggtgtgcctggacaatttttatagtgattgctgtgagtaggtgtgggaggatgtggggtaaggacagggaggagctggtggaaacaaaccttttaaagtagctcaggctctgggaaaggcctcagtttgttttctctctagagttggctctggctgaagaggatggatggggtgatgaggaaagcttaatttaaatagagtcccacctggactgggatcactgctggcctgagttctctattagctggtgactcaagcataattagtgaggggcccacatgatgagcctcgattttgatccaggtctgaaccatgcattattttagtatctggacaaggaatacatgtttttttcatcagtctttattttatttggatctgttctatattgcgagttgattttgtctttccaactgagattggaaacccttagaattaactgttttttaccttaatgtggtattatcattttttctgtaaaacatgtagaaagggccagatagtaaataatttagcatgtgaggtccatatattcccttctgcaactactcaacttcatgctgttgtgacaacattttatttataggcactggaaattgaatttcatataattttcatgtatcacaaaatattattctttaaacaaagaattgcaaccttgtaaaaatgtaaaatacattcttagctcatgccctgtacaacagcagactgctggccacatttagtcagagggcctcagtgtgctgacctctcaccttgttttattctaaattatggaaaagcagatatataaaaacatgaaaagatgatgatgaaaatagaaaaaaggtggtaatgatgatgtctgtttagattaattacataagcagataaatacttgccatagtaaagagctatttggcatcataatgagtgacacaaaagcaagagaactgggttttattctaactttatctgtcaactattagcaatcatgggaaaaatctttcatttatttatttatttatttatttatttatttatttttgagacagagtctcactctgtcacccaggctggagtgcagcggcacaatcttggctcagtgaaacctccacctcccaggttcaagcgattctcctgcctcagcctcccgagtagctgggattacaggcatgcaccaccatgcctggctaatttttgtatttttagtagagacgaggtttctccatgttggccattctggtcttgaactcctgacctcaggtgatccaccaccctcggcctcccaaagtgctgggattacaggggtgagccattgcgcctggccaaatcttttaatttctttaatcccaatcttttacttctaagataatggaaatggattataatgtttctaagatcattttcactattgagattattccatccttgtttacaactgctatcttctcccgtgtataactagctaccaatttactattgttttacgtatagtatacacaattataagacgcaagatcctaaaataagaggtgattgttacaattgaaaatgaatactttgggcccggcgcagtggctcacacctgtaatcccagcactttgggaggccgaggctggtggatcactcgaagctaggagttcaagaccagcctggctaacgtggcaaaaccccgtctctactaaaaatacaaaaaaattagctgggcatggtggtgcatgcttgtaatcccagttacccaggaggctgaggcaggagaatcacttaaacccaggaggcagaggttgcagtgagctgagatcacaccactgcactccaacctaggtgagagagtgagactctgtctctaaaacaaaacaaaacaaacaaaaggaaattaatactttgctcttaatttgtccttaaagcacaggctgtttgtggagaagcacaatctttaggcctcttaatgatttgtagcatatcatcactaagcagacattttgaaaaggctaagaaagatgaaatcaaagtagaatataaattatacatcagataagtcccattatgaggagggaaaaaaatatttggatgcacatggcctacctcttgctgtcatcaaaagcacttgtcaggatgaggcccttgcagcaggtactagagttctactgatttagacttcaatggctggtgtgttgtattttatagtgtaaaataattacaattactttaaaaattgttatggtccagcacaggccctataaatggcataataaatagtctataaataataatgtgaacctcactggaactaaaccacattttcccatttttctaaagcagaacatgctaagaaatagaagttattaaaaattaaaggggatagctgggcgcgatggcttatgcctgttatcccagcactttgggaggccgaggcgggtggatcacctgaggtcaggagttaaagaccagcctggccaacatgacgaaaccccatgtctgctaaaagtacaaaaatcagttgagcgtggtggcgtgcacctgtaatcccagctactcatgagtctgaggcaggagaattgctggaactcaggaggcagtggctgcagtgagccaagatcacaccactgcactccagcctgagcgacagagcaagactccatctcaaataaaaaataaaaataaaataaaataaaataaaagaaaggcgatggtcaacccatacacatgcttttaagagccctgtgctatgttttgagctgataaatacgaggccaagaagaaattaacctcacaatgattatattttttagtataatggtttctatttaacttgagcatacttaaaacgaatgcatcacctagaagccacatcaccccgcttcaactcagactctgctgtttctgtcaagagaatcacatttcttccactcacaacacaaacatgctgtccttgacccaccctctgcgtcgtcttaatcaccaagccttgtggatccctcctttgaaagagctcttcagctgtcttctcccttttgttttcctgccaacttattcattgtcttcttcccagggcagaccacagttctgccacatacaggagacccaaaattgtctatgaaagggagaagtgaaggtagtcctcagatagtttatgtaccaggacaaactagctacatgtgggaagataatctacacaggtttaattcagctgatgggttgatttcagaagatttcagcccattttattattttgtttcttccttttttacttaaaaaacaaacatatattgagcatttattatgtaccaacaaaacaaaataaaataccaatcatctatgtattgagggtagaggatagaaaagtacattttctcccattcaagtactaaccagggccgaccttgcttagcttccaagatcagaggagatcaggcacgttcagggtggtatggtcatagacagagaagtacgtttcctaatattaagatattgggctgttctcagagtgcctacaattgggaagaaaagtggtacaaagaaaatgacaaaatcagaagcccccccacagctcagcacatactctattaccaaattagtgatacggatgtcaagtgctgtgggtcatgaagaaaaggggatggctgtgtttcaatgtcctttaacttttcatgcactcagacttggtctaattcaggccacacagaacaaagctagctgaatcttgctgtctcccacattctcaaatcaaacacaccttacataattatctcatgttcttctttttagaattatgtatgccactgtttccttttgttggcatgagtcagagtacatttaacacgacttatttacttctctactaaaaaaaatttttaatgtttcatgatcagaaggctatcaatattttatattaatcactgagtaaatatatcagtagagctatttaaaaatcctgctggcctgtgaaggaaaggcaatacgagagaaatgattaattattaactgataaggattaattactgaccatatattatgtgccagcgacagtgccaactgttttcatggacctcctcttctttaattcttgcaatggacattggtgataggtaggtctccttgttatgaagaatgtttttagaggtaactagagaactctggggagttaggctgggaatcatggaatagttcttttgcctaaatgagacatggggaaaaatactgaagagagattttcttgggggatgaaattagagatagggtaatcatctactcttcagagtcagaagatagatgcagaagacagagaaggggagaggagagaggaggaggaggatgaggagagagagagagaaaataagagagagaaaataagaataagagggaaaataagatagatactttgtagcaatttaaacgtatagagattatttctagagttttcagtaagctatgagttttcctgggagctgttttaatcatttcttttttggaaaatacaccatcacagaatgtttcttattttacatcattagacgtatgatggtatctcttccagagacatggcccccaaaagtctgtgatagagaaaaaccatatggtacttttggtgcagtcatttaaggaacatgaagaaagagccctactttgtattaatttggggtctacctggaaaggcccttcagagagaaacttgtgttactattgcctcagccaccctaaagccatgcacacacttagaactcagggtgcagtttttagacattattccaaatgaggatgttgcactctactttaaaaagtataataaaaagtgttatattttacaatcctagactctacaaagaatgataggatattctcagggatcgctttgcagcagagggaactggaccagccagagccctcttccttgcagttggacagcacaaagctccctgtacacactttttaaaacataagttgtacatgtgaaggtatttggtggctatcatatgaagtttaagatgtgtggctatttttcccttccatggatatggataggaaatcaaacatgggttttaagcatgtatttctcagctggtgtagtctgtgttcagaatacttaacatatctgtgctataaaactcccgtgtatatttgcatatgggacacaccacaggcacgaggacgtgaacggctccagcattcactgaccgtcttctgtgtgccaaacctcagtggggcactttaataatcctctcatttaattttcacagaaacctataaaataggtatctgaatcattacatattcaaatatttcagtgactcttcactgagcagcgacttttgccaggtgttcttgcagggctcacagcagacgcatttcagccctatttagcttacattctagtgggagagagaataaatagacaaacaagtgcgataagatgctatggaagggtaagtgcatgaggaactacacagcaggattggggacagagaacgtcagtgggaggacgcagcagctgagtgggggtcctatttttcagaataaggtcaggagatgtctcctgcacagattcgaaaaggtgagaagatgagccataagccattgagtaacttgactaaaatcaccctgagaatgcatttatatatttaaacagggcagcatttaatacctctagggattatgtaggacacttgtattgctttatctttctcaaatcttctccattgcatcaagtatccaatctgttcataaatttgtcttaattaatgccctcatatcagacatacctcatagccagcatcaggcgctcctgtcctcaactccatgtgggccctgatcaaccctggcgctttgcctcctgttctgggctttcctggtcacacagagggcatttactgatacccacaatgcttaatccatggtccctcatattaaagccatctgctgggcttagcagcagccagctccataaagtgtcctagtttccctgcttcactccccggccctcccgcctctgtcctgggactaggactgtaacggagtaagagcacctgagccctctgcctcaggctctgcttcctggagagcccaggctcttatattatatttcaaaatcccagaggagaaggagacctgtcttcatttttcatctctcccagtgtcacaaatagagttattctcctgagggttaaccagaagttattccaattttgggtccaattgtgaactgatggctgtaagacatacagtaatgactttttttttttttccaaaaaacctagatgcgagctagtgtgtggctggttgtcaagcagaaaactggctgataataagggagggagctgggagcttggaacaggggatcgatgaaataaatcggctgaaaatgcagaatgaaataaaggcccgttctcaatgaatctgtgctgagtcccccaaacctccactcacaccccagttgcagtcagtgtgtgtctcttccttcgaagcacgcgtcagtctcagggactccatctctggagcctttcccgggcctgcctctcccggtccttccctgtagaaacggtctctcctaccccagacactcattctcgctccatgtttggaacatgcttactctgaagttagatatcctggggcataagttatactgtggcgtgtttggaaactatgcaagcatgaaatatacacagtcacgagacagaagaggaggcacgaaaaaccaccccgacacccagcttttcctgacgggaactaaatacaatgcgtatcggactcgagaaattccgaggaatggaaaggaaaatcgccggtagcatccaccgcgcatcagacacgagtcacactgacagccagaaaaaaatggaaatccccttcctagaaagaaaagaactattttatatcccaaactacaaaattaaaacaacaacaacaacaaaacaagtctgccagttgaggcgtttgattgtagaaggcaggccactgtgataagcatttgactctcgtcaaaaaaaattcctgtttcccttgaaatctttgccctatttcccctactattaacttggccatagtcactttcctctaagctttcaaaatttcctagaggcttgcgattattttatatatctaaacaatatatttaagacttttaaaagacctgttttttgtttatatataaataaaaattatatactatatataaaatatataaatatataaaatatataatatatataaaagaaatatatattatatgtaaaatataatatataaaatatatatgtaaaatataatatataaaatatatattatatgtaaaatatatataaaatatatattatatgtaaaatataatatataatatatattatatgtaaaatataatatataatatatattatatgtaaaatataatatataatatatattatatgtaaaatataatatatattatatataatatataatatatattatatataatatataatatatattatatgtaaaatataatatatattatatataatatataatatataatatatattatatgtaaaatatataatatatattatatattatatattacatgtaaaatattatatataaaatatatattacatgtaaaatattatatataaaatatatattatatgtaaaatattatatataaaatatatattatatgtaaaatattatatataaaatatatattatatgtaaaatattatatataaaatatatattatatgtaaaatatattatatgtaaaatatatattatatgtaaaatatattatatgtaaaatatatattatatgtaaaatatatattatgtaaaatatatattatatataaaatatatattatgtaaaatatatattgtatgtaaaatatatattacatataatatgtgtaatatataaatatatattacatataaaatgtataataaaatatataatatataaaatgtacaatatatataaaatatataatatataaaatgtacaatatataaaatgtactatatataaaatatataatatatataaaatatataatatataaaatgtataataaataaaatgtataagatatataaaatgtataatatataaaatgtataatatataaaatatataaaatatatataaaatgtaaaatataaaatatataatatataatatataatatatattataaaatataaaatataaaatataatataatatattataggtactttatatataatatataatttattatattatatactttatatataatatattatatattatatataaagtatataatataataaattatatattatatataaagtatatacattatatataaagtatatatgatatattatatataaagtatatatattatatataaagtatatattatatataatatatataaaaatatacaatacatatataatataaaatatatgtgtgtgtgtatatatgtatacatttttttctgagacagagtctcactctgtttcccaggctagagtggagtggcttgatctctgctgactgcaacctcctcctcctgggttcaagttattctcatgcctcagcctcccagtagctgggattacatgtgcgagccatcacacctggctaatttttgtattttttgtagagacggggtttcatcatgttgggcaggctggtcacaactcctgaccccacgttatctgcctgcctcggcctcccaaagtgctgggattacaggcgtgagccactgtgcctggcctgtttatgaatatattctcatcagcacctgtcaactgctgaaactatggaaaatgggctaggagctctgctcaacactgcggctatggcaataagaggtatcatggcagtcctcacaaatctccctcttgttgaatggggatctgatgagagactaacatttagaagaggctctgtccgttttgacacaggaggaacttttagtatttcacgtgggaccccaaggccacaatggcatggaaatgactgtcagcattcacctaactgctctgaggaaatgtgcccgtggtgacataattagtaaagtgagacacaggatcttgacctcgaactcatgtcctatgatcctcccctcactggcatcccactcataagtactggggccatgcaggatgttaccagatgttccatgggtgccgttatgtaacccatgactttgaccttcactcaacactgtaggacctgagacttacattcccaggtagtgaaagactctcagaaggcaggagtatcagaggatgtgctgaaacctacatatcttcagccattgcttttcctgttcattagctaccaaatataaatggtttaatatttttgtgctgaaagacacatatcttatgtcattgcttttcctgtctcattagttaccaaacaaatataaatgttttaacatttttgctttcttttaagccatattgattattacactgcttcttctgggtacttaaactatattactgaatatctcccatcatccttgattttgagattattgtctttccattttttgttttttggatgccaataattttttactcatcgttacttttctgtttttgacacagagtcttgctatgttgtccagacggaagtacagtggcacaatgacagctcactgaagcctcgaccttctgggcttaagcaatcccttcaccccagccacccaagtagttgtgactacaggcgcatgccgtcacacccagctaattttttaaatgttttgtagagacaaagcctcactatgttgcccaggctggtctcaaactcctgagctcaagtgatcctttctccttcgcatttcaaagtgttaggattacaggcgtgagccaccatgcccggctttattttcacttttcttatgaaaaagtgtgtagtgtcatccaagattaatatatccctacattaagatcctattattttcaacatgtatgtgattttgaaaatattcttttattttctactattattttttctattctcctatcacagttggatgtttagaagccagtatctgtagaatattttaagttttatagactaattgatctcctcaaacactgataaagatccctccctccttcttaaaaaatacccactggaaaccattgaaatctttcatattcaattcaaaatgtcaagtctattaaaatttaattcttattgaaatatttgatttgccatttttcagaagtattcatacttcttgactagaactgctcatttgcaatctagagacctattctgagcatcaggtccttttgataaaggatatattgaccatcacaatggacgcaaatgattcaatgcctgaatcctatatgtagtcccgaccttccctcttgcacagagactctttttcaagccacgtagttgcctgaaccttcatttctgatgcaggtgtgcacagtggtagtcatagaggaggaaactgtgaagcagcccaaatcccactggtgtcccccactccagccacggcggccccattcctcctgtctggaccctgctaggtgaggacagcctcaggctcctgtgaagggctcatgttcctgaccatcccagagctctcaccactgccctccatggcccctccagggaaacacctctccaaattttgccatttcatggcctacatcatgactattttaagcaagactaaaggctgataatgcaaatatggaaacatatttgcattttttttttttttttgagacagagcctcgttgtgtcacccaggctggagtgcagtggcgcgatctcagctcactgcaagctcagcctcctgggttcacgctgttctcctgcctcggcctcttgagtaactgagactacaggtgcccgccaccaagcctggctaattttttttttcttttgtatttttagtagagacagggttacaccgtgttagccaggatggtcttgatctactgacctcatgatctgcccgcctcagcctcccaaagtgctgggattacaggcgggagccaccacgcccggcccatatttgcattttaaaaagagctttagttaagagtgaccgaagagagaatgtgaagccccctggcagttgctaggatggcatgtggggtggacaggccttgtaaggtcccctaaattcccccgtgtagacagtgacacactcccatatatgcagtatggcgctcaatgagggagtgggtgggctcattttatgcaaaagggatgtgataacagctaagccatcccatggccgacacttggaggtgttctcttgaagggtgggtcagcctcttcctctctgctggccagtttcttgtgtcaaagagccatggattctctacacagtcggctggagggagctatgaagctagtggctcggaatggggaaagagtaaatgctccaaatcaaaatgaaacgtatttgctgattacaaccgatgagttgctccagtcggctcgatgtcaaaagtagaaagaaataaatttttaaaatgtaatcttctattgaagtataatgtatatacagaaacatttgtaaaccatgtttcctgttaataaaatttcaaaatggaaactcactcatataaccaggaactgaatcaagaaataaaatgctttaagcgccccagaaacctttcttagtggcccctcccaatcaccatcccctttcatcccagagccgaccactgtcctgattttcaacactaaggatttattttttcttccttttgaaatcgcacagtacgaattattttgtgtttgaattttctcatgcaacactgagtgagatttactttatagtaggatcagctactaatttgcaggggccattacgaaatgaaaatgcaaggccattgttgaaaaatcaagaattccaagatagtgacagcagcacattaaaccaagcccagggtccttttagtgcagggccctctgcaactcaaaggtggcagaccccaaagccagccttgtagagaatcccaaagcatgactatactatatttgtccatcttactactgatgaacatatttgtgagatttccattctttggtgctcctacaaacattcttgcacctctttggtgaagatatggatgcatttctaataggtatatagttgtgaatggaattgaaaggtcctaggcagacagatgttcggctttggtagatgcaagcacaaatttgttgtatcaatttacacttctacagtcagtctttgagagttccagtggctcctcatccttaccaccatttcatgtcttatctttttcagcctaggcaggaatttaaagtgccgattcctaccctctgctccaaaccttatatcattagcatttctctccagattctatattttcacagctccccaagcgattctccgttaagttaggaagcactgctaattaactgagctaggaagctatgagaacatcacatgcaatgttctcattgcaccagagtcaaatatgggttgaaggactaagaatattgagctcacacttttaccctctaggtaaatcagcaaatgattaccaagtgtatgggaagtggccaggacagggacattctgtatggtcattatgacatttctgccttttttttttttttttttttgagatggagtcttgctctgttgcccaggctgggtggagtacagtggtgcaatcttggctcactgcaacctccgccttccaggttcaagcaattctcctgcctcagtctcccgagtagctgggactataggcgtgagccaccacaccagctaactttttgtattttgagtagagacgaggtttcaccgtgttaaccaggatggtctcgatctcctgacctcatgatctgcccacctcagactcccaaagtgctgggattacatgtgtgagccaccatgcccagcccattatgatatttctatgaaattgaagggagtagtgtcaaagggtttataaaagagcattatggacttttttaatgttagaaacttgatactctgaaaacacactgaaacttatcgttatagagtctttttcattttcaaccttctaatttttattttagataatcaaagtaaaatcacaccattttacataattacagtgtattttaaagcttttcttttttgtttcagatctgtaggacatccacttagcaacagcatgccattttcttctattttctacactttaggcatatgcacattagaagtagatgaaaatgcacagaataaaggaaattctgtcaaaatatatggttcctcagcaaagaagcttggagtctgatactatgtgaaatataaacagtaacttggggattcagatgtatcatatttatgctcttttcatgtttaattttagaaaaacacattcatggcaatggtatatgtagatactgctatttctaaaatatcttattaaaatgataatagacaatgaatttcaatattttatattttcagagcaaaaatcattcacaaaacaaaaattccttatgccacatggcatatgtgtatggtgcatgtgttccatgttcgataacatgtgctaagatatataataaaaatttctatttctggtcatcctcacataattatattttgaacatgcatatttagagcgtaaatgtaaagctctatggcactgagagatatgatcatatttatcttcattttaggaaatgtaagtatatgggtaatttatataacctcagctatctacatctctgcatcgttatttttcccccacagtattagggtattcttctccgcaagtgggatatgagggcattaccttatacatgtccccggaaagacagtgcggtcacagccaccctgcctggggaggagcaccggcccacgaggtggggtgggaggtttggctgctcctggcttggtctccaccggccatgggaagccagcttttcctacaaggaggcccacttatattcctcaagcccagtgcatcatgagaagaacgcacttcctgggcactacctccccttcccctgcttttcatttccattgaagagtcggtggtgacccgggaaaaggcaagaaacttaatctgtgcttccaagacagccggaaagagcagcggcccttgttctgaaaaagcacccaagaacccctttagattccgccagcacgttcagggttataaggacgtgggagattgtttccccaacacctgattagttaactcaaacagtacctccagaaaactagttatgtggggtttgcttttttcagtttctaagctttcatagttaaagacatattttcatgtaaaaatgaaacctttaaactgcacttgtagaacctacaaagggtagaaaggagggcctcaccaatgcctctgcacatcttcagccctctaccccatactcagggttcccacagaattcgaagaccttgaaacaagtttccctggaaaacagatgttggagggacacatgtcatcctaatgccccctgtgtggagacgcatcagcagccagggaactgctgaaaacagatgtggaagttggaatccaatccgggtttgccaggggagtaggaagttccgccctgccaccctttttctttgcgggagaggtggtacacagagtgggaattatgtgtaaactacaagcgtcggaaaaatgagaggctaatgcaagaatatggacctgtccggtgagtgcagtgtgtttcctgagtggggctgagtggtttagggctgcgaccaccacagtcctcctcacacacgaccagattccatgaatcccactgcaaatatgcattccctcctgcactcggtaaggggccaggacaaatgggaagagcgttgcaaatacgtacaatccccatgggtctgatggtcagcaactcagagcaatggaaatgatacttaatcgtctctaagaaaactggaattcaacaataaggttacatttcacagactatacacctacagcaactcattagagcctcctgacactggggtgggtggaaaggactaagcatgattgtcccgctttacaaaaacattggactcagaaagggcaactgaaaacggacaacacagaagtcgtggctcctttgctcccgatggcaaacccactagtgtccagaggttctggagcatcttctaggcctttctcttttctgatgctgatagggaatgcagtggccagctaggacaggcaccatggcagagtgggaaactgaaactgccaccactgcccatccccccacctgagttttaaaatttaaaactgttggtgggcaaatgatgaaccacccggatagctagcagattattcagaatagctatatagagccttggtaatcacctcaattctagaatagaaacagcaaatataaaattaaacacaatacaaaatccaaacaaaacatgtccattcctgtgctttggaacttcagctcaacagctcaccttgaattatgtaaataacagcatcacctgttattcctgacttcctttttgtttgtactttttattctattttattatgttgtcattttcccacaggtgaaagggcatcgtttctgatgtcaaagcagtaaacactttgatcacagcaacggcatgggggcggggcgggggcgtgcggtgcaagaatcaggcaggtggtgcggccctccagggaggggaggctgcggcaggcagtgagccgcctccccagcccaggcggcagcttccctccgggccttcctgcaggaaagcagcactcccacaatgagctcatcctctgaccattctagtcagcttctcatcaattatcccagttttgggggctctgagtttgggagttaaactgcataaagatcaaactcaggcttctcaagtttcacttactgtgggagagagtacagtcactggagtcaaatatgttttaactgtttcctctcatttccatatcaaagcaaaatgatgtgaagatggatgaagaaggttgaattaagatacaactccacggctgggcgcggtggctcacgcttgtaatcccagcactttgggaggccgaggtgggtggatcacttgaggtcaggagttcgagaccagcctggccaacatggtaaaaccccatctctactaaaaaatacaaaaattagctgggtgtggtggcgggtgcttgtaatcctagctactcaggaggctgaggcatgataatcgcttgaatccgggaggtggaggttgcagtgagccaagatcatgccacagcactccagcctgggcgacaaagtgagactctgactcaaagaaaacaaaaaacaacaacaacaacaaaaaaaaaccaaaaaaactccaggtaggtattttttctttaaaacttacctttacatatagataaagataaagaaaggcagaaatagaggtaagagagataataacatttttgttagagaatagaattgaataaaataaatttcctaaactttggtttaatcatgttttagaaaggaaacatctgaggccaggcatggtggctcatgcctgtcatcctagcactttgggaggccaaggtgggcacatcacttgaggtcaggagtttgagactagcctggccaacatggtgataccccatctctactaaaaatacaaaaattagccaggcaaggtggtgtctgtaatcccagctactcaggaggcagaggcttgagcccaggaggctgaggttgcagtgagctgagatagcgccactgcactccagcctgggtgacagagcaagactctgacaaagggaagggaagggaagggaaggtggggaggggaggggagggcagaaacatctgaaacacaacactgcagactggttacctatatctacctgtgagtagtaactagaaaacacagacacagcatgcagcaaatcataaaatgattttttattaatttatttttatttttattttttttattaagacagagtctcactctgtcgcccaggccagagcgcagtggtgagaactcagctcgctgctgaaacttccaccccttggattcaagcaattttcctgcctcagcctcccaagtagctgggattacagccgcgcgccaccacgcccagccaatttttgtatttttggtagagacggggtttcactatgtcggccaggctggtctcaaactcctgacctcaagtgatccgcccatcttggcctcccaaggtgctgggattacaggcatgagccactgcgcccagcctaaaatgattttctttttgttactcttgaaaatttatgtgattttctttttgttactcttgaaaatgaagtggggtgggcggtaaaatataacattaaacataacatgaaactaactgtcaactaacatgaaactaactaacttacttggttggttatttctggttgtacagccttctagggtttatttaccacgtggacacagtgcccctatatatcactaatgtattttagagtttcatgaaaacacactgatgaaagaaacagctcatgtttttatgtacattagcatgtttctaatgcagtaaatttttgtgaagatgtgtcgtgtcaactaattcaaccatttaagtaggtctatcagtttatatagaatgaaaatgaagtttcaaggcctatgacaatacacagcagaccactgctatgagctgaatttcattttgcagcttagtttcattttaagattctactatgacatatttagctagagaaagatattaaatccaactcttatgtatttaatataattcgactcaagtgcttcaggccttcacctcactttatgtaaccttaaaatgatggatatgcaacttttgatgtagggctctattttaactgtgagattacgatacgaatggtgattcttttatcaagtaatttatttttaaattctgctttctgtcatttctaattttgttgaaatagtaaatccacttagcagagagtactcatgatttagctcataatttgattcaatgaaattagttcttgtacctcttctgaatctgtagtagtcaatgagtctagacgggttatccatgtgtagatctatatatgaaatgtacatttattgtctacacaaagggtcagcaaacattttatatgagaatcaaataatgaatatatttaaattttgcaggtcatgaggtctctgtcacaaccacccaactctaccattgcagcaaagaatagcactagacacataaatgaatgggctgactgtgttccaataaaactttatttacaaaaaaaaaaaaaatgctatctgtagtttatagacccctggtctaaacttttgctattcatgaacgtagttctagacctactgcatcttcattaactagaagcttattataaatgcatttaaccatgagaaagctgatttgaaagaaagaagaaaaactaaaaaaaaaaaaaaaaagaaatgcatattctcaggcttcaccccggacctactgaatctgaacctgcttcttcaagatgcccaaggcattcaatctgcttcttcactgcccagggcatctgagtgaacatcagcgtatgggaagtgctagtttaaaccacagtgactggcttctatctgggttcacagagcagataagggaggtttcatttgtcattttagctgtctattcaacaataagaatgtctgggccgggtgcggtggctcagcctgtaatcccagcactttgggaggccgaggcgggcagatcacgaggtcaggagatagagaccatcctggctaacacagtgaaaccccgtctctactaaaaatacaaaaaaattagccaggcgtggtggcgggcccctgtagtcccagctgctcgggaggctgaggcaggagaatggcgtgaacccgggaggcggagcttgcagtgggccaagattgcaccactgcactccagcctgggtgacagagcgagactctgtctcaaaaaaaaaaaaaaaaaaagaatgtctgagccctcctgtagaacaacattctctgaattaagtcattgggatatcataagaaaaaatgaggataactgttcatataatttttaaaaattttgaaaatataaactgaagttaagaattactgatattcactgtgcaggtggacactggctccatcattcagactctatgtcccaagtttgaggagggaagaaaggagttttcatcacacaaggaggtggcaatggtacctccatcaatgctaacctgtttcctctccaaatgtggggatataaaataatggtttgcatttgcaaaactgagtgaaatgctctaggtttaacaaatgaatcttctccaaacaagtgctttaaagtatttcctgcaaagaagctgcgaaaataaaatgatactaataatataagcacaactgaacagcaagaaaataagacagctatgctctaattcatgtatattctattcacatatcacattatgtaaaaaataagaattaaatttttaacttaaaatgataaatgatgtgatacacaaatagaacatgcatgaattcgacgaaatacagatttactgataaatctcaatctgatagaattctttgaggtttttcattaataatttcttgaaaccataattaaaatctaagcattgaaaacatgaaaacaaacttctccaaagtttgtgatgttggccttggtgctttaaaatcatcaagaatatttaataggctgggtgcagtggctcacgcctgtaatcccagcactataggaggccgaggcgggcggatcatctgaggtcaggagtttgagaccagcctgaccaacacagagaaaccccgtctctactaacaatacaaaattagccaggcatggtggcacgtgcctataatcccagctactcaggaaggctgaggcaggagaatcacttgaacccgggaggtggaggttgcggtgagccgagatcgcgccactgcactctagcctgggcaacaagagcgaaacttgttctcaaaaataaaataaaataacataaaataacataaaataaaataaaataataaaataaaaaaaaataaaataaaatgaatatttaataataaaattctagaagtctcttttgagtttttcttgtttcatttatttagtttcttaatcgtgaaagaagaaaagctatatactttagggaaattttctccgtattgcaacaaaatgactgaaatcatacaaagaaaatactgtggcaataaattgggatatgtttgcttgtcaaaaacttctgaagaaagatgtgtagaaattattactgatgaagcaaagaagcaaatgttagaacaaatacattccaggtttgacacacgtgtcagctgatggtattttatatattctctcccaataatgaagtacctgaaaaacttatttttcataaagcattaagttgtactgtaagagatgtggtctcaacatagtttcttgcattaaaaactattatttgatggttgtgttggattactgtagcactgatggagtaactatcttgatttgagaaaaagactcaagctgaatggttacagaggtagtactggaagagtattcactcaatgtatgacttacaaaaaagatgctgagcaaagaaattaaagccagaagtaaaaagtgctacaagtgttactgatgtagttaatttgataaaaacaaaccttcaacaatgcagtaggctttcctctgctagttggaataaaatagggagggactataaatcctatttgtaccacagaatttcactccttaattcacagtataaacgttgaaagtactgtgaaagagttactcatttttcctttcagcaagttagtgaaacttttcaaggtcgtcatgtatgattgtataagagatgcattcaacaatgttaggggtcaccacttatattattcctaatgtattaatacaaatatctttactctgaaaacattttccagcagatagcaatgtgtcttgaaagaagtttttaaaaatttgcataaaagtgctacttggacttgtgtagagctttgatatcaaatgactgccggtagaaatgcaatctagcagatattttagaaaagtaacaaaaacagttattttgtcccattaaggtcgatgcgatttttaccagatatagaaatatcttttttataaaaggaagttgaactctggagcaaacactttgaagacagatgtttagaatatttccactgttttatgaatttgttttaaaaaataattgtgtcagttatgaaaatgtatatcctcaccctttaaggagcttggaaatagaagtgcatattctgtttaaaaatctttcaaataaaatgtcttagttttgaacatatggtttaaaaatgcaataatggcccaccttctaaaactgcttgacatcaatggagaaatttattaaatttcaagaaaaatttgaccatttgcctaattatcagatgtgatttgaacattaatatcatgttccagtaggcagtagacaatgtgtccttccatttgggggtattatttttgctcattaactccctccaatatcagcatatgacagctgaatgtcagcgcttaccttctacccattcatgttaacagcttctgcagccctcctagctagcatcgaggtcattttcttactttccaacacttctgttgtaatgcggtacaacctcaatgttctcacaacacattcattcatccaaactggcctcaatctttttctcctcacaccatacggtcttgccatcctctcaactttgcccacctctcctggggttgcaccatgtaccagtagttttcaatctctgggagttgctcttgcatccaaaaccaactgaattagcctttctaggagtggggcatggggaactatatttacattttttccggttgattttcacacattgtgacagttgagaaccactggtgtaggcctgtcattatcaataactgcccataatcttcataatcctccagcatcctttgatcatcacttcataccctcagctcaatccctttagtaaccccacttgaataatttttcaactctactagaaccttcaatccattaaccctcctaacttttcattattcattactccctcctgtccttagctccctccttgcccagcttagacttcatgcttcctcaatcccattgctggatttcttttttagagtacttactgacaaagtctctcccaaacatgggaaaataaagttcattaccctattctgtgcctgcctcaagaagctgactttgggcagacaaaaatttacatccttactaatttaaatgtaatttaaacataagaacctaaacttcaagtttatttccataaaaactgtacttggatatatgatcggcaagaaaataaaattaaaagaaataagagaactacggaaataaaaaagatatattccaaggtaaaaagacgaagaacccaacaaagtaaccacgaagtcagagacgcagagatgtggggtatctgagggtcaccgaagaaaagttttaagaatgaagaatggacaaaacaactcaattttgaaaacagagagaaatggagaccgatgatcacacaaacactgtatatgaatgtacacagcagctccaatcgcaactgccaaaaacgagagcccagatgtcccttattgagtaaatgctcaaatacactgtggtgccagccacacaacagtcaccactgagcaacagagagggatgaacaacgggcgcacagcatctcaaaggcattgccctgaataaagggagcgccttaaaggttacctactgcatggttccattcatccagcattctcagacagacagactggagggatggaggccaggtcaggtggtgctgggagatgacgacacagccacagctgcagggatttgcagtgagggaagagttttgaatcctggttatgccggtagccacagtaatttctacaggtgttaacattcaagtgtacatcaaaaggaaagaagtcaacacaactgtaagacaatttaaaagttttaaaaaatagtgttggttgagagaatgcattcaataaatgtaaacttccctcttgagagttttgttaaagaaactgcagaactcttcagagaatatagggctaatgaaaatgacagcttccaattatctgtaatttttttaatgttttcaaagcacttattattatttattgctaagaagcttaaaataaaatgtagtaagaatagaaaccaaaagaagccccatacatttagtaatcagtatatatttgaaagtacacgcattcgaggagcagctggggtctgaggcctctcacttagactcatggggtcagaacaggtctcgtatcagctctccagctcccaacttctattattctgccgtctcccttgtgtgactaaagcaatgagatgatttattcattcaaatcctatgaaaatcagttcttattttacagtattctgagaatgttatcttacttcctagctttttaaaaggctttcttcctgagatgctatttttcaaaatcagatttatttctgaaagagtccctgttctctttgccaacctccttgtagctggcaaacttcccttttttccttcaggatgaaagaggccttaatccatcttacacaatattcagtgtacagcagccctggtcttggcatcgcatcacactcagtaaatgacacagagcttcccaagatttcagactctggggttccacaacggagacgagagcaaaaggatgtagtcatttaatctatgctatgcgttcagaaaagctcactgagtttgggactcatgggctgaagacgaagaggagccatgcggccggatttaagccttgggggaatgctggagaaaaggtggatgctgtctcagatctaatgtggtcctaacagagttgggaagacagatgtctgtctgtgccgtgaacataacactctgtcagggatttaccctgggaaaagtctgtctttctctattcaaggcactgttgattcatttggggaacagaattctacattccagtcaatgaatctacaagacaattgggaaaggatcacattagtttttaaatagaatttattttccatagtgttatttcacagcaaactctgttccatttcccgcgctctgcctccggggtcttagaacaatcacttcttcagaggaggaccttgccaaccagtacactagatgccaggcggaacttgcctttacagcagaaaatgaagtgggctactgtgatctatcgtcagagtttctcaatccattctcaagataccccgagggagatttcactcttgctacaaagcgggaaataacaacaataacaatcaccgctgtaatagaacacattatgagggggcattcttttaaaagcctttaaaatgctaccaggagagttttatggctgctccaagtcagaacttggccgtgtttaaaagcacggggagagggtgttccggaggcggaccccaggggggccacagcgcctccccttcccctgggggctctgctagttttttggctgataggatcacagccaagttcatgggcgccccgaggaaacactaggcacagcttgtgctgttcaaaacaatcttaccataaaagtgacttttctttttaatctaaaaagcactttttgtaatgagaggttgaagctgagatgccagtgagttctgctagtttctgtttacttccttcaatttcgtattgttcggtgtgtgactgaaaattgggtatcaaaggtaagtattagggtcttctcctgggtccctaaacatgaggcttcgaggtcttacaggcttgaataattcttcagaaactacagcaagtttgtttttagagtgtcttccaagtaccagccctttgtctaacatctctacaccctaaacattcctcccaacctttgaaggactccaaattgtggccagactacaggggatttgtgaagtgcatgcatatctacagggggtaagacaaatacatcttcattctgacatcatctaggtttttcagaggtaaaagatgtagagtgtctgagccacctatggagaaagcagttagatctaattatagctcttgggatagaggagctgctgtctcaagaaaagcaaatatgtaggttaagagccctgttcgaccttcagagatcatgctgttgcacgcttgttagagtgatgcccttgtttagtccttacctagacatctcacaaatattcctgtgaagttttcttggaagtggatggtttacgaaattcccaatacatttcctttgcatcctgatggactctctgggtgacctcttaactataacctttcaagaagcaaattttttgaagtttgcaatcaggcaaacaatcctcactcttcttataaattctcatcttccctaagtgcttatatttgaatattcttaaaataatgggctgggtacaggggctcatgcctataatcccagtgctttgggaggttgaggtgggaggatctcttgaaccccagaagttagaggtcagtctaggcaatgtggtaaaaccctgcctctacaaaaaatctttggaccagccacagtggttcacacctggtatcccagcacttagagagaccaaagcaagaggatcgcttgaggccaggtgtttgaaatcagcctgggtaacacagctagactccacctcaaccaaaaaaaaaaataaataagattagttgggcatggtggtgtgtttacttcctccaattccttttgttcggtgtatgactgaaaattgggtatcacaggtaagaactaggggcattttgctgggtccctaaacatgaggctttgaggtcttacaggcttgaataattcttcagaaactacagcaagtttgttttcagaaaccaaagaggctgaggtgggaggatctactcaagaggctgaggcaggaggatctcctgagcgcatgagttagaggatgcagtgagctatgactgtgccactgcactccagccttggtgacagagcaatatcctatctctaaacaataaaaaaaattaaaaattttaagttaaaaattaatggtcattttgtgaaattggtcagagtttaaggttttagagaatgtacctggtggcagaaaccaatatttagttgttttatgagacggagtctcactctatcacccaggctggagtgcagtggtgcaatcttgcctcactgcaacctctgccacccaggtttaaccaattctcctgccttggcctcccgagtagctgggataacaggcacctgccaccacgcccggctaatttttgtatttttagtagagatggggtttcaccatcttggccaggctgatcttgaactcctgacctcgtgatccacctgtctcagtctcccaaagtgctgggattacaggcgtgagccaccgcacccagcccatcaatattttgttttaaaggtgcttaaaaaagacatatttatacattccccttttatagttaaatcaaaagcggcttttggtatgctctttcaaggcaaaggtatagataatcccagccatcaggattttactgagtgattgaaagtagaggggtaccatagaatactaacatatcagtaattagcttagccagttaaagcacagaattgaggagggctggttatctgttcacacgccatgaagttgagttagctttgttctcatcaggaaacaaagtatcctatagatgcctaatgttagaaacaacaataatatagtttaaatagacactgggctcaaaccttaaacactgtctgtgccttcactatgttatcactacgttactgttgcaggaacagagacagactagaggagcgaccttgggcaagttcttcatcttttctgagcctcagtttctacatgtaaaatatggaccagtcagtagtatccacctcagaaagtgtctctgaaaactaaataataggttctttacacacactgcttggtgcctggcaaataataactcaacaaatataagatgataacaatgatcccatccagtcccagccacaaagtgagcaagaaataatgattcagagttttaaaggagctgtgtctttcttattctgttactctgtggattctgagacttgctcaagatgcttcatgcctttctccttaaacctatctgtgttctcctcgacggatctgggtaagtcatctctccactgccaaacattttggcacacgatttgtcacaaagaagaacacaaaattatttttgaatgaacaaacatatgaagtaaaaagccacattcattatcgatcctattcctatccccagctaagttctatgtgctataaatagtgagttctgtttgcattaaatggtgtgaccttctcctgtgtcctcagatggaaagttctcaccattggagacttttctgacactactctctcttcattagctccactacccacctgccaaccccttcgacctaccaaccccaccatgaactactgacaatctttctgtggccactgccttcaatgactttcccatgaattcctttccttttctactgtggtcactgatttcatgcgagtctcattatttccttcctagaccactatggtattcttataacatctctcttcaccccagttcagactataaatgactgacatattaaccttcctcaatcatagctgtaaaaacattcctactttttccaaacttttcagcagttttccattcccttctaaactacaaccaaactcatcaggatgggattccaatcaatcctcaccacagcacctgcctttccaagcctcatttcccatttagtgctttgcttggaccttaatgtatcttaaatacttcctgttttcaaatcgtgcgttactcatgcatttctccatgtctggaatatgctccttgcgatatacttatctttgaaattcttcccgtgtttgtgtcctaagtgaaattagcctttctctatgggaacgttttcacatgcccttccaggtggtcacagatcctagtgatctcttttgtatgcgcttctagacacattgttgatatctggcttgccatattggcagaattattacttacaaacattaaaatgatatgcatgttggacaaatgtggtccatcatttataactgtatttatttaatgaggatatgatttggtcctgttctaaagtctaattatgtgcttattccaccaatgcttaagatggaaaatttgaagcacctccaaaatctgaggtgggaatagatgttatttctgaagatctgacctcactctgttataacaatattttatagaccgcttatttgttgctatttttaaaactttgtattgactttccttacatttggttgctttcatgaccagtgaaaaaactttcaagttaaaatatagctgagaagaatgaaagagaaatggtaatgtaaagcttcacatttaactgccacagcaggaaaactcaaaattgaattccaaccctagctactaaacaccctggtaaagctttgctccagcttcactgagccaggaaatttctctcttttcccctctgacactagagtcggcaagaggagacctgaacgattggcataagaaaataaataccccttccatggagggctcacagaactagagcctgctaaccgtggctggacttgcttgcaccctgaaggtgctgacaaggtgtgcaggtggccaggaatctaaaacacaacactgcctgggtccccctggggagccaaaccccagtgaggcttctgagattcaggagtacgcccaccccacctgccgttatgccccccagtgaggcttctgagattcaggagcacgcccaccccacctgccgttatacaccccagtgaggcttctgagattcaggagcacgcccaccccacctgctgttatgctccccagtgaggcttctgagattcaggagcacgcccacccctcctgctgttatgccccccagtgaggcttctgagattcaggagcacgcccaccccacctgccgttatgctctttttcacccgtagttagctggggtgcctatgagtgcctcagtaaatatctgttgaacaaacaattgaatggacacatgaatgaatggatgagggcacagtgggggtaaggggcagggttggagggaagaattcttagagaagctgagcagtgaaggaaaaataggaattacccagacgaagggagctggaaaggactgaggggcacagaatcagctgagctggtgggaagtgaacaagtaaagctaaggggctagagaccaccttgttatcagtaagaagggaaaatcccctcagcagtgttggaggagagactaaagtgcgggtgaagcagggcaggtgtgacgggtgatgaataaattatgtgagagaaaatatagctgtcaggtatgcttatgagacactacatttatgtgtagaaaggactatggaagaattgaaggtggccatgaattcttttgccctcctcctattgtaaggtggggtctccccttgaacctgggcagactctgtgactactctgctgaatagaagacagtggaagtgctgctctgtcagttttggggctcatgcctaaaaatgggcagcttccattccctgtcttttagatcactctctctgggtgccctgagctctgacactgcccatttagcagaggccatgtgtctatctcccatcaacaaccatagtggaatccattcttccagccacacctaccaagatgcctgacatgtgagcccctccaccagctgagcaccaccaagcaacctcagtcaacgccatatagagtagaaacatcccctgacctagccctgcccaaacccataacccacacaatgataaggcaatagataaggaaaacacggcatgtaagaactaatggcgacgggaggagctgggggagcaggggaggtgatgtatgcttattttcacaggaccaagcttcgtaagtgtttacaagatggtgttgtcactgttgggggccttttccaatattatactcttgcctgtggttccaggttcatttcctttttctatatctcaattcctgatgctgaaattaaatttggaacaatgaaaaaaaaattccactggatctattttctggtcatgttctattcctagataatataatattcagaggacagaagaaaacccgtcattgttgtagaaaggcgtgttcagcacgcacagtcacgtacagcacattgtggtgtaatctcttgggcatgatagaattggaggacaggaagaaatgattccagtaactcaatcaatgaccgatgatatagttttctgagtattcctagtatcttctaactttctcttctacatgttggacactatcactgtctctatcccttggcctagatagcagctaaacagccgatagctgagccaacagtgttcaatactcatatcctcttctttgttcgagctcaagtgaacacgtggcattcattcctaactgcagcctcctcaagcccagaagcctgaatctgttttttaatttagcagtgaagaatgcagctacatcacatgctatgagagcagctggtgtttcatgcttcttctctcctatcatccctctcattcaacttctcttctttttcagatatgcggtcaccttatttatgtatgtgttgaggctccctttcaagactccaaaaggtctaatccaaaaaatagctgctaaagtattatctcttttttaggcccattttccttctgtaagagaagaatgcttcattgggattagggaacatagtggtttgattgattagactgcttaccaaagcaatacaatttcaaatgataaataacagatgtgggtactctatacagcaattgtttaaaaataattttgcttctatagtacattttggcttagaattgtgtgcttctaccctctgtgataatttatgttgttcatggcatataaaatgtctcccagttgcggccgggcgcggtggctcacgcctgtaatcccagcactttgggaggctgaggcgggtggatcacgaggtcaggagatcgagaccaaggtgaaaccccgtctctactgaaaatacaaaaagttccgggcgtagtggcgggcgcctgtagtcccagctactcgggaggctgaggcaggagaatggcgtgaacccgggaggcggagcttgcagtgagctgagatcgcgccactgcactccagcctgggtgacagagcgagactccgtctcaaaaaaaaaaaaaaaaaagtctcccagttgcatagaaaaggtttttctcatctgctacatcttcaattaaatcaagaacaaatctctgattattgagttttaagaaggatgactataacagaacttgtagcaaattttccatagtaaagcaaaatcactataattgatacttgtaattgatactttaagctgccttgtatttgccaattttccagttaaaacgaatctgtaaaactaagatattacaaatgaatttcaatcagcaatcagatcaatttggcacagtgaaccctttgaattacggaagtattttacttaaagtttcatgaggagtcctgatgcatataaggtagaagggaaatgagctacaggttctagggaatcacgaaggtcccacgagcaataatatttacgcattacatctgtatattgctttacactgttcacaatatcctttcatctacataatttttatgtacacttcacaacagttctccaaatggatataattatcttcatcgtgcagctgaggaaacggaggcacatacaatttgtgctcctcacagccatcgtttatgggaaaacgctgtggctgaagtgggtcatgcagatgattactaaatggatgttttcaaagctaaagttgcgggcatctttgctgacagtggaatgtcattttggtactgggcgaagctatctgggtagacagaacttccagagtgataggtggcaagtttcataaaatgtctgagtttcttagcaatagttaaaacatggtttaatcagatgataattttggtgattccccctccctaggctgcaacagctttaattttaagagaactgaggtagtggtctaattcctattgcaaatgtacgcttgtggcttcttcgtaatttgcagtgaagaatctagaaaagtgatggggaataatgtctaaaaggcccggaacgcttataactcagcataaagcagcctatcacagctcaatggcaaatcatcggttgaagtcaagggcaaaagggcagggaatccaagggctcctctgcccaaagcatcgcttacttgaggttggcagctggctgcacagcagcccttggctgccttcaaggaccggccagagtcagcatcctccaccccgcagctatgtcagcgtggcccagacagtgactgtggagtggggaggccctggccagccaggcacacatttcacagatgaggctgaaatgagaaacttcagggagatatttgcataaatatatttcccattgtccaaaaataaggccagacggaaacatctttcagtatgttccgatgagaattacaaaatgttatacaaatcaattttttacaaaggttattatgaggtttattctgacagaggacaaagcctttccccccttattaaaactgttgctgacatcactctgagggaagtcttgggaaaaaccaaaaataatatgtaggtaatattttgcaattttatcaaatatttaccaaaggctcagataaaagatatccagccacaggtgaagggtgttcatcactgggaagtggggttgaggggaatgtttattttctcactcatatttttccatttgctacggtagcacatcctacctttataaacaaagatatttcccactgcctggctcttctcttcagcttatcgatgatatcacctgcttatcttcgaatgggtcagaatcaacaactacttaccaaacatacactgtccttttttctaaccaattatttttctccagtcatctacaaataggtcttcaaggcgtattcccatacgttgtactatgtgtgtattgtgggattgagtacagcagggaagtcatatattttaaaatatggacaaccgggccgggccaggcggctcttgcctgtaatcccagcactttgggaggccgaggtgggcagatcacttgaggttaaagttcaagaccagcctggccaacatgatcaaaccctgtctctactagaaatacaaaaattagctgggcgtctgtaatcccagctactcgggaggctgaggcagggagatttgcttggacctgggaggcagaggttgcagtgagctgagatcatgccacttcactccagcctaggtgacagagtgagattctgactcaaaaataataaaataaaataaaataaaataaaaatatagataatcggaaaattttagtgaattcagaggaagcagaataaatttaaagctgaaattatcgagaaggtctttctggaactgatagcatgtaaattggactatgcaccgtgcaggtgagatgtgaacgtgttgaaatggaagtgagagggagtccactgagaagcagcagcagcagcatcaggaaacaagacatggagctttgggtgacgccaataacacatgagcctggatgctgctgccactgagtgtgggatcaaattagagaaaattagagaaaaataatatatatttttatatatatataaattatacataatttactatgtaatatataatataaattatatattataatatatattatatatacaacatatcttttatatatattataatatacatattttatatgttatatattatgtaatatattatatattaatatattatatattaatatactgtagtatatactataatatactatatattatatattatatataacatatattatatatgttatatataatatattatatattatagtaatatatcatataatatataatacattatgtataacatatatttatgtattaaatataaatatatacaacatacataattatatataaaatataaatatataataaaataatatgtaatatatattatgtattgtatattatatataattacatatataatatataatatacaatacataatatatattatatataacacatatgttaaattgtatatatatatatatattttttagatggagtctcgctctgtcacccaggctgtagtgcagtggtatgagcttggctcactgcaacctctaactcccaggttcaagcaactttcctgtctcagcctcctgagtagctggcactacaggcacatgccaggacgcccggctaatttttttgtatttttagtagagatggggttttgccatgttagccaggctggtctcaaacccctgactcaggtgatcctcctgacctcaggtgatccaccggccttggcctcccaaagtgctgggattacaggtgtgagccaccgcgtccagccaataatcaataaatttaataagaaaagtaaaaaagcagtttggatcgatggcccaaggaagagacgtagtgtactgagtgcgaggaaaagcatgtctccagtatgtagttaaactgcaggataaatcagtcctgcctgggggagagaaaaagtagggcagaggatgggcaggccagtctccttcacccctgtgcctggagtgagtaaattcgtctcattttcctcatgtccaaatactcacatcatgagatattacaaagctgccaagacaacacacctcagattttctgaaatggtctaaatttcaaatattccactccactctgcccataagtgttctaatgtggaatttttggtctggcatacagaaacaacggcattcagacaacagattacaaacaatggagcgggtctgatttaaacagggagaaggacataaaaatgtagatatttgccttaaaacaaatattaacaagaacaggttttgattgttacattttgtaaattcatcgtggctgcaggaaagactcagtgatttatgcatttgaacagagagaggtatgatggcaaaaggacggtgattttgtccaggaggtaactggagattctcagaaagggtcctctgaccctgctgctgcagctgcgagtgcttcagcttgggctgcgaggtgcaagttcccctggagagagtgggatgccgagtcatggagccagcagcctaacctggcctgcacattaagtgatgaatcagagcgtgtgatgctgacacacggggctttgcttccgaatggtactttcttcccaaacgaaaggcaaattcctctacctccatttcactgcaatgttatcaatagcagactcttcctttgacttgagaaaaataggagaacaggggtttctaagttaacatttccctaaagaccctggctgggcttatgctgcctctttccagcaatgcgtcagggcactcccctggccggccccgtcctcgcaccctctgtgagcatggtctgcttcatcccacttgcaagatgtcaaaacgtcaccaggctgcagaggctcagaagagactggcttctgaactggacttttgattaaatcacgagagaagactgctgtgtagtcttttcaaactgtgtgttgtgattcaataagaagtctaacctaaatgggttaagacggtctaaatatttcatatggttttgcttattcactcaaaataattatatttttaggcagagagtggtttagagtcactggtgtgtgtgtgtaaatgtaatagacatccgtctatctatctatctatctatctatttatttatttatttatttttttttttttgcgacagagtcttgctctgttccccaggctggagtgcagtggtaccatctcagctcactgcaaccctccgcctcttgggttcaagtgaatctcctgccttagcctcccaagtagctgggattacaggagcctgccaccacgcctaatttttgtaatttgagtagagactgagtttcgccatgttggccaggctggtctcaaactcctgtcctcaagtgatctgcccacctcggcctcccaaagtgctgggattacaggcgtgagccaccttgcccggctcatctatgtatttcttacataggacaaaagcactaaggcacagcgttagggaaacacctcatgctgcctgtataaacccctgctctcagaaagttgtgtgctgcaagatgggcaagacggtgcactgtgctggaatactggtttctggctggttctctacttaacaagtaaggcagtgagtcatctgatcctcaccttcaggggaactgttcatcgctattgtctttaaaggcagatgtccgaagttgcccagcacccagtgtctagatctagtgagagggatttagaggagtctttccaaaggagacaggacggaagcagcgttgtgctggaggcggctgcactggctctagagccaactgtgtctttccttcccaagtctgtactcagtgaggagacactggtagcttgaagctggcccagatgggtgtatttacaccacagaaattggcagcaactgcaaagtgggctcttttgtttacctcggagatctgcttgctaaactttcaccaattgttggatgaaagctagttctgagtcaaaaagatgaatatgtcttgaccaaggagacagaagtcaaacttcgcgaaggcaaagaaaagagggtgggaccttcgtttctgagctgacagccgccatctacctccatgcagcctctgatgggaggaaaattgttgtttttagggtgaatgaacatcaaatattatttgttgggttgccaaccaatttagagtcagaaatacagggaaagacagaggacatgagctcatattttattcctaacaaaacctacaaaacacagtgctttggatttgtggtcaaaagggctgatgaatattttgcctcagaatgaaacagatatacccacttaagtatgaggaaagagataaagaaagtgtgcagggaggagcctgggaacacagagaactttctttttttctttttctttttttttttttaatggtcccttttattgtatgtatgcgcagtgctggcctggctttgcaatgcaagtcctcagttaagatatagtcaaataactatggctgcagtttcgtctgcaggatccacaattcagatacaaacagggagctggggtgggcaggagaaacaggagggaagcagagtgcagactgtccccagcactggcctcttcacacagggttggcccaggcagacacaccccatggaatgatgaggaaatgacaacatggtcccttcccacagtgagcctggggctgctaggaaactgcccttcagaacctttgtgcccaggttgtcttggagcccaacaactttttatttggattaattaaaaaataataagttaaaattaagcaacagctgggtcctgaggatgctgagccagcacgcccacagtttggggggaaaaaaatagccagaccttttttgagggggcaaggtgtgttggcttgttttcgaatttgtggggttttttttttttttttttttttttgagacagagtctggctctgttgcccaggctggagtgcagtggcacgatctcagctcactgcaacctccacctcctgggttcatgccattctcctgcctcagcctcccgagtagctgggaccacaggcgcctgccaccacgcccagctaattttttgtatttttagtagagacggggtttcactgtgtcagccaggacggtctcgatctcctgacctcatgatctgcctgcctcggcctcccaaagtactgagattacaggcgtaagccactgcacccgacctcaaatttgtttttaaaaacacattccctgtgaggtaagaccgcagggggtgggcctctgtgaaagcctgaacttgggatgtgccaagtcgcagattcagccaacaccatctctgtatcctcttgggaaacagggactggggatgggggtgtgggtcaagaagagcgtgtggccagcaagatggggttgtgcagaggccgagctgcagagacagaccttgagatgcagaggacaaaaggcaagggaatgggaggtctgatgtggggggagtcaggataggactgcagccgtggaggtcaaggtgtggatggctctgctgctgcattcttcccctcccaatttctgattgacattctaatttttaactcttacacggacttaaattttgtttaatgcttagctacatctccatctgcgaagtttggtccccaccttgaatatccaccacgtaaaataaagaaacaggagcctgggcggtattttcacctcgtctccctccacttcccagctttttttcaactataccattattgttacattttcaagatttgttacatttacgttttattctgttaacaaccatgattacatgccttgcctctgagtggatgctggaagtgaaatagacacactcgtgacactaactaactacgtttgctggctggagcctgaaggtacagtctcattcttgtgttcctaaacctgggtcaccccaggaggaattttctgaaattcagatcaaacgaataattattccttacactaactttgaaaaatctttttgctgtatgtctatggacaggtttctggtgtagacttttgcttttcctgagtgtcaaagctgcctttccttcttcttgttgacagaagcaacacagggattccccacgggagtgctcagctctcccagctcattcagtgtctcgttaactgactgctctaagttgactccttccttttcagatccgcttccaagctgtctttctggaattttcttactgaatcccctgccttcctttatcttgggttttatttatatatatatttttttaaagtacattttcggccgggtgtggtggctcacacctgtaatctcagcacttggagaggccgaggtgggcggatcacttgaggttaggcattcaagaccagcctggccaacatggtgaaaccctgtctctaccaaaaatatgaaaattagcctggcatggtggaaacggctgtaatcccagctacttgggaggctgaggcaggagaatcacttgaacccgagaggtggaggttgcagtaagccaagatcacaccactgcatctaaaaaaaaaaaaaaaaaaaaggacattttcaggtatttttttcctcctttgggaattctttttaaaatttaatttaattttaaaagagagacagggtctcactatgttgcccagactggtctgtaactctagtctttcagcagtcctctcacctggggcctcccaaaatgttgggactacaggtatgggccagtatgctcagcctgggaattcttttcattcattctgaattgcatgtgtcttccacattgttgagtttccttgtcctttactgcagtccatatcatataataatatcatggtatattttttgaaaagttgcatggaagataacaatttctggatgctccatgtctgaatgtgtcttaactcgtttacacatttgataagaactggaataggtacaggaatccatgttgaaagaaacttcttctcagaaccttgctgacatttgcccagcttccaccatcagcatcagagggctgacagcaagctctgtgcctggcacaggacatggcttctcattgctgtagcttaagggacctctctggccaaggagaagccactcgactctgggactccatctagctttctcttggttagatgatttccagtagcttcttttgctattaattttgtgagtatttttacaaccttctagggatcagggtgagttatacccaagtgtattagtcagggttctcaagagggacaaatctaatagaacatacatatatatatatatatgtatatatgagtttatttagtagtattgactcacaagatcacaagataaggagcaaggaagccagtcctagtcacaaaacctcaaaagtagggaagtgacagtctagccttcagtctgtggtttaaggtccaaaagccccgaagctgaagaacttggagtctgatgttcgatgccagaaagtttccagcacgggagaaagatgaaggccggaagactcagccagtctagtccatccacgctcttctgcctgcttttattctggctacactggcagctgattagatggtgcccacccagattgagggtgggtctgcctctcccagtccactgactcaaatgtttatctcctttgggaacaccctcacagacacaccaggaatgatactttgcatccttcagtccaatcaagttgacactcaatgttaaccatcacaccagatattcctctgagatgtgaaattttcagtactattcctatggctttgttcttttctctgcccttatggataaaggatacacttctgtatttcattttggagaacattatttcatgctggttctagatgaatttcactggtttacaagaaacttcactgttctttgaataaaaataaggcaaaatcgtcaagggttttgagactatttggaaaaaaaaagctcgaaaagaatgggatgcacaaactagttattgttgaggcaatcagcatctcaactcctattacaccttaaaaattatttccgcaacataaccacacttgcaaatctcttcatttttacacatatatacacatattctatattagcactgaattttgctaacagctcacatttgccaagttattctaacttgtcttatttatgttcaagttttcatctttcccctactgcttgaaataaaactttgtgtcattgatttatttttgtgaatgtgcactggggacgtaagagaggaaaatagcaggagaagtgtaaacaatggcatgaaagtgacgtaagacgtgagccaggatggtctgtagagttcggactgtatttgctgagatcgaaaggaccaaacagcgctctcagcaaaggtgcaaacttaagaaggctgcaattattagaacataaagaatttccggcgaggcgcaggggcttatgcctatcgtcccagcactttgggaggccaaggcgggtggatcacctgaagtcaggagttcaaaaccagcctggccaacatggtgaaaccctgtctctactaaatacacaaaaattagccgggtgtgggggcgggtgcctgtaatcccagctactcaggaggctgaggcaagagaatggcttgaacccaagaggcaaaggttgccgtgagtcaagatcaagccactgcactccagcctgggtgacaaagcaagactccatctcaaactaacaacaacgacaacaacaacaacaacaacaaagaacataaggaattttccaggaaagtgaaactcaaaacttgacatttgtgaaataaatgtgaacagcagtattcaatcaatttagctcggaaccgtcaatgacctggggagcacgtgagagtcagtggggcagatttccggtacatggacgatacctagagaggtcctagtctgaaagaatcttccggatggaaacagggcatcttgtttatacaagcccaggtctctcacagcaaattcaactgtatgttccttctcctctcctgccagattgccagttactttgaggggaggaatatcttctaaattttctgaacctcctggaatttgacatatcgactgtattctggatatttaatgaattctgtttgatgacacaggtagagtaaaatggtcttaaatcattttgacagaggtaaaaaacattttattccacactttacttattctttttctgcctgaagtgattacaagaaaaaaaaacgaatagtttaatttaaaatccagattggtatgtaattatcacaaaatcagtgaagttcttttcaatgaaaaaaaaaaacaccagttctataatttggacagacaaaatttagcaataacaaaattaaaggtacaacccttaatctattaattatttaaaaatgcatctcgaactatttttctttttatttatcccttgtatcaatagacatttaattggcaaacaagaacatggaaaaatataaactgtaactcactgtaataaactctaaatcaatacaaagagtctaaaatgtgttttgacgtccaaatgtagctacagccactgtgtcctgtgttctataacacagagaaataatacaaaatgattaaaaaaataaaataaattgaagagaggcctgtaatgtaaggggcgctgtgtcactctcaggcagcaacgtgagccagtgagtcaatgcacgaggctctcctgtttgttggtacttcctgttctttctttataaaatacatggagaactaaatccgcaggatgctcacacaaatgattcatagagaaagcttaaaagaatctcacgttgttaatgagcatcacaataggctctgctcatgagaaggcattttgtttccgcagaaatgttttttcttactctgtcctgattttgatttctgtttaaattcagtaaacacattaccaaaatttaaagaaggtgacttgttttccccaactctcagttcaccaaaggtatttcatctatttgttctgaaaatgcagctgctctctagatgtatgtgtgccctgataagaaatgttttgtgtaacaataaaaatcatttcttttgattaaaaaaaaagaatctccagtcgtttacactggaaaacgagagagagcgcttgcatactttcttcacatatattaatggtgggaagaaaatggatgtagagtaatagggcctgaggaactcatagaaggaaccggacatgtatgaaaagatgatgactgccaggtggcactgacgcagcctccagcccctctatcttaggctttcgggacatgtgctctcttgcttccgctggacagtgtctcaatactttcctccctaaaagcaggttttaccctggtcagaggtgctcttgaggcccaaagaagagatttccacaaatagtctataagagcatgtacatactataactgcttgataagtgaatgaatggatgactaaatggagtcaatgctttcatgacctaacgttgtggttatgggtgtcactattctcttggcaatagtgcaatagtgaaatagtaaaatagtctagatgtcattaagaaccttcatggaaaacatgccggtgggggaaggaaaacaacattcatgattcatgggaggagataaaatagcaacatgaaggggaatttggaagatgctgacgctagccctcatgggtgattttgaggggttcaagtcttcagtggaggaagtaactggaactagaattagaagtggggcctgaagatgtgactgaattgtggcaatctcatgataaatcttgaacagtttacttcttatggatgaacaaagaaagttgtttcttgagatggcgtctacttctagggaagatgccgtgaacattgttggaatgacaacagaggattttttgtttgtttgtttgttttttgatacagagtttccctctattgcccagggtggagtgcagtggcacaatctcgactcaccacaacctccacctcctgggttcaagcgattctcctgcctcagcctctcgagtagctgggattacaggcacctgctaccacacccggctaatttttgtatttttagtagagacggggtttcactgtgttggccaggctggtctcaaactcccaacctcaggtgacccacccagctcagcctcccaaagtgctgggattacaggcatgagccactgcgcccggctgaaagaatctgaatattacttgtagttagttgataaagcagtggctttgacagggtttgagaggaatgactccaattttgaaggaagttctaccatagatagaatgctatcaaacagcatcatggtatagagaactcttctttcacacatgaaaggaagactcaattgatgtggcacatttcattgttgtcttattttaacaagtttccacagctgcccaaacaatttggcagtcaacaccctgcctgatcagacagcagccatcaacatcaaggcaaaaccctctaccagcaaaaagattatgacttgctgaaggctcagatgattgttagcatgttttagcaataaagtatttttaaattgaagtatgtactttcttaaagaaataatggtaataacacttaatagactacaacatagttagttttagaagcactgggacaccaaaataactgtggacttgctttactgtgatgtttgcttcgtgagggtggtctgtaactgaaactgcattttctccaaggtatacccatatttaaatagaaaatggactttcttttactaaggagaatggtattttcatttgtctcatttttggagggaaactctagagaagaagccaagacatgcccactgtccctctcccatcctatggaggctgcccagtgccaaagaggaagtggtcactctggtcactcatatacacacagctggcacaattgtcacagtcgctcccctttgtgacaggctggtggaatgacttacagttcagcccaccaaatataatacagatgaatttagtcattcagcctcatgaggtcacacttttactgttttcaacaaagcttaaacccccttcccacattctgtagaaaaaaaagtgatgacttccggggttgttttctaggccatttctatcagaactcctgcaactcgccagatatttcaactcttcggaaagccaccttgtgtccattttatgtcccccaaccctggataatgtctctgttttccatgtacctaaaaacattgcaaaaaaatctgctattcaacatatcttggtgttattgtcactggaggaaaatggaaggagaaaagcaaacagagagtatggaaataaatacccgtcagtatagaaatgtagtatatcataaaaatggcacttcaaaccagtgggaagcaatgggtcattccgtaatacagtactggaacaggttaataaaaaattacaaagtttaatttagatctccattgtattccttaaaaacaaagtaaatcccaataaaataaaaattcaagtgcgaaaaatcaaagaaagcatcaaaagtataagaaacgatgggccaggcatggtagctcatgcctgtaatcccagcactttgggaggccgaggcggacagatcacctgaggtcaggagttcgtgaccagcctggtcaacatggtgaaacaccgtctctactaaaaatacaaaaattacccgggtgtgatggcgggcacctgtaatcccaactacttgggaggctgaggcaggagaattgcttgaacccaggaggcagcagttgcagtgagtggagatcacaccactgcactccagcctggacgacagaggagaatctgtcctaaaaaaaaaaaaaaaaagttggatgatgaaaaattttctaagattgcactggtgatatcttccttgagcggacgttaaaaccagaagccataaagtagtaggtgcaaacctctgactaccaataaaatgtttaaactatttctatggcaacgtaacaaaagcagaaataatcttcttgtagtctgctctactggtggtcaccagtaaaccattcttggcaaaaggcatgcccctgtacccccccaccctcgtgaatctgagctgggcctgtgactggccttcaccaagagaatgtgacggacgcttcagaacttggcctcaggagtgctggtaggtcctgcatttgcactcctggacacccctgaactaagaagtacagctgcaagaagaacacagcacgtggagaggtggtatggaggggccacgtggagatagagagccctggaggctacatggagaagagcacagaacccagctgacccaagaactgaggccccaggactacagccccagtcaagccattccagttggctgccagccatcctcacctcctagctgagctccagacacctaagcagatgaggtctctgagacaccacatctccagcagaactcatacaggaagagcaccacactgtcctcatggggccctttccaaattcataaccctcagaattttaaaaagtaatatgttattttgttttaaagacatgggataggccgggtgcggtggctcatgcctataatcccagcagtttgggtggacgaggcgggtggatcacctgaagtcaggactttgagaccagcctggccaacatggtgaaaccccatctctactaaaaatacaaaaaattagcctggcatggtagcaggcacctgtaatcctcccagggaggctgaggcaggagaattgcccagaggcggaggctgcagtgagctgagatcacaccactgcactccagcctgggcaacacgagcaaaactccatctcaggaaaaaaaaaaaaaaaaaaaagacatgggataatgtataatgtggcaatagatagctggaacacccaatagtcaaactcaaaagaaaatcagcaaactgggaaaagactaagcaatacatatgccaagagactaacgtcttaaatatgaaaaaagagcttatgtgtaaataagaaaaaagtcaactcaatacaataggactcaaaacttactgcaaagaacaaaaacataagtggtcaaaaatcatttgaaatatgttcaagctcactcaatcttattgaaaaactgagtaatattcttttacttgcctattggattggaagatatttaaaagtttaacaatgaataaaattaaattaagtgaaataaaataaaataaaaagcaataaccagaatggaggtgatgtgaggctcatgaaccacttgttgagagcaatcattgtttacaaaaaacctactatgtctatttattcattgacccagcaatataatttctaacaatatatcttataaacatgatatactcaaggatacagcgatacatgaactgttatggactgaatgcttgtgtctcccccaaattcatatgttgaaaccattacctccaatgtcatggtatttgtaggtggagcgtctgggaggtaattagatctatatgaagtcatgaaagcagagaacccttatgggatttgtgtccttatgagaagaggagaaaccagagctcactctctgtcatgtaaggacagcaagaaggcagctgtcaataaaccacgaagagagccctcaccaggtttccaatcggctggagccttcgacttggacttcataccctccagaattgtgaaaaataaatttctattgttcaagccactcggtctatggtattttgttaaggcagccaaagcagactaaggctagaacaaagatgctcatgaagcatcatttgtaatatcttaaatgttggaaaattctacatgtctacccttaacaacctcattcaataatttgcaacacagctatacaacgtaacactgtaaagctttttatcagaataaggtagtattatatatactgatctctgaggatgtctagatattggtaaagtgaaaaaaagaataagctgtaaagtagaatttactgtaggattctatttgtgaccttttatgaaaaagatataggcacatgtatattacacacttgtaggcatgcatacttctatattatatttctaagtacacattgggagctattcatggtgattatctctgaggatagggagtattagaatggccaacttggtatgaatagggaataaagaagacttactttttatactacacccatctgcactgttttttttaacgtgaaacatgtaacttttattaaaaagaaaaaaaaattgtgaaatgcttcatagtcctttgtgtcaagagctctgccataacccaaagcacaaaacctaggaggtctgttgatcttaatctacactttggcctcatacatggatatagcgtgttggttggtaccatgcaaacactgtccctcctttctgggttggagaggaatcaggagtgtttggagaaaaagaaaagcacatcccctgaactggcaagcgatactcatgaccatcagcagccacaggctccattaacaagcaggagagggatgtttccctggtctcaccagcaataaatgtgtctatggggaagcaaagtttctaagaagtgcttaaggaactctaggcattcctagacagcccaggctctgaatttagatgggagaaaagtaggcagatatcactgaaaatcatgttgttttaaaatgttcttttttgcgttgggtgcggtggctcatgcctgtaatctcagcactttgggaggctgagacaggtggatcacctgaggtcaggagttcaagaccagcctggccaacatggtgaaaccccgtctctactaaaaatacaaaaaattagctgggcgtggtggtgtatgcctgtagtcccagctacttgggaggctgaggcaccagaattatttgaacccaggaggtggaggttgcagtgagccgaggttgtgccctgcactccagcctgggtgacagagtgagactctgtttaaaaataaaataaaataagatgttcttttcaagtttatcgattaattttcatgaacctgaaaggtgtttgtgaaagaacaccctattcttattattctatgtacaaagagaatcatattcactcttaaccctcacatcaagacacttactttgatacatttttaaaggcttgaaatccaaaatagagttttaattttcttatcaaaaaatttcaagcctttatatcaaggtggtaggattgttcatctcttttgtgtcaaccctgtaaatgtgagaactgtaattgatctctgctatgcgtgagtgacatggaagaccctgaatatgttgtagaaccagaacattttcattacctacatcatgctgtgtgtcaaacaggcatgccaatcagtttgtggatctaagcaggccattgcacatgcaaacgtgtatgataggtatgacagtttaacttagcattctcatttggaaaacattctggaatatgtgaataagtaactggaaaattcccaaatagacatagcattgcggttcagaaacatgaatatttaccattgacagagagcaagagagaaagcatgcacacaagagagggtccccatcaaactgaacaatgtataagcaagaatccacagtgcaaattggaaggatgatcatggctgcgaggctacagttatgactaaacaaccattgataaatttattctcgactatatcaaatgataaagaaaatagctatgaatttactgaaaaaaaagcattatccctaattaataagaaaaaagaaaaagaaaggaacatccagctcaaacacttgtccaccaaatagcacaacagatattgagaacactaatatttggttataaaggacaagaaattgttaagaagaaaagtaatttccactttggtatttctggccttatgaagacataagatacattgggaggattatggaaacataagtgattgagagaaaatctcatgagaaacttaagaagatgggactgtttatgaaataggaataccacccataattggacaaagacaataaaaaatttttctaattacagtatcattccataagtatacaatgtgtattatcagtaggtgaatatcataggccaaatgaaaagcaaacaagtaagtaaaaatattaagtagaaaaatattctcatgagtgattgatatgattacatttgaattttagaagatgtcattagtggagatgtgaacagaatcaggatttaggatgaagtctgggaaagctgttatgaggctactgcaatggtctgggctcttttggcatttcctctttaagctaaaattggccctttacttactatttattctcttttccctgatatttgctcttcttgtttttaaaaaatccttcaatttaattttaaattttatggctttcctcttcttctacccggttccgttccttactctgcattgcaaattacacagatagtataaacatagacgacgttagtctttaattttaatttttctttttctttttcttttttttgaggcggagtcgcgctctgtcacccaggctggaatgcagtggcgcgacctcggttcactgcaagctccgcctcccgggttcacgccattctcctcctgccccagcctcccgagtagctgggactacaggcgcccgccaccatgcccggctaaatgttttgtatttttagtagagagagggtttcaccgtgttaggcaggatggtcttgatctcctgacctcgtgatccgtctgcctccgcctcccaaagtgctgggattacaggcgtgagccaccgcatccagcctaatttttctttttctttttttgagatagagtctcactctgctgctcaggctggagtgcaatgacacgatctcggcttactgcaacctgcagctccagggctcaagtaattctcctgcctcagcctcccgagtagctgggactacaggtgtgtgccaccatgcctggctaatttttgtatttttagtagagacagggttttgccatattggccaggctggtctcaaactcctgacctcaggtgatccacctacctcgtcatcccaaagtgttgggattacaggcatgagccactgcacccggccgattttttcatttttatttcaaatttctgccatatattttggattctctctttaaaaaaaaatctgtaacattttaaaagcaattttggcattaatatttgtggtagtaataaggttttacatgatggattaggatatgatgacaatacaattcttaaggttaacacagccaggagaattatatggccaagtgaatagatctttagacctctggctttggaagcttcttatgaaatcctaagagatttacagacaacaaatgtttacaacatttaggcacacaacagcataatactagacacaaatactaagcaatattcagagtccaaatacagccatactcattttgcttgtaaaaatttagtttttcaatttgcctcctgctgcacagaagtaatatagcaggtgattcatttccacgtttgaactgctgttaaccacaatgggtgaaggagagcgagatgcaggcttcgctgatcatgtcacccttggaagaaaggggaataaaattatagggcagaatgacctatcatatttccttgacaggtgctaattcactttgatctatccttcaccataatttcattggtggggaggacatacatatttataagtgtggaaacaggcgactgtttttctgtttgcaatttacaacaacaaagaattcatttcaattttcatattagaagtcccaaggtgacccgggagtagataccagtcccctgctgtgcgggatttctaacataataaggaataaagcacaacaacagtacattgtgacctgggctcatgggtaatcaattcacatatttaccatggaaacaacagtaccacgcagaacatcgtcattgcttcaatttgctgacgaaagccctctagaacccaggaagagtgtgcgtgaaagctggctgattaatctgacttacttatgctttgttaaagagttattgtcttaatcataattaacactaaatagttactcatggaaaagctgcaagagagattcagctctacctcttatgaggcttatggtctgtgattttcaaaccatgagtcatcgacaaatatatacaatgaaacagagattgagccaaatgggaggacaccagggttttgatttcagaagtcggatttagaatttcattttctatgcaaaatactgcatggtatacaaacacctctcaggttatataatcatggtgcattatctttgtacccacaaaatgcttaacgaactcagtggggtgagttctttttcttctaaggaaggaaaacaaaacttctatgcacgggaaaacaagccagtgcacggcatgactaacacaatgccatgtaattaggcaaaagctttgaatagacatttcacttaacgagatatacgactgggttaataagcacatggataagatgtttaatatgactagtaattagagaacgtctataatgaacaagttgacaaaatctagtgtcggtgaggaagtagagaaactagaaaccaacacccccgctccccaccaccaccttttgctggtgggaatgcaaaatattgcagccacttgaaaacattcgagcaatttctgaaactgttaagcacacgactgttagagccagcaattcctctcctaggtatccaactgaggagaaatgaaagtgcagatccacacgaagagttttacgccatgttcacagtgtaactcacaataacaacgcaaatgtccatctactggtgaatggataaacaaaaggtatcgtatccttgcaatggagttttgctcatcaagaagagtttcacgtacaataactttgagaaaaatctcaaaattacgctgagggaaataagactgacaaaagattacatagcatttgattccatttatctaacatttctagaaaaaaagacaaaactctataagcagacagttgatcagtgtttgcctagggctgaaggtgggagtgaggatggctcaaatatgcatcgaaaaactttttagggtttatttttctgaaactggattgtgataactggttgcccaattataaatgtgtattagaaatgatcgaactggacatatacctggaggatttgcatgatgtgtaaattataccccaataaagttattggaattcagtaagaacatagcttgctctagatggttaaaggtttcagttgttcctgttataggatcttaccattatgaactgtcatcttcccaaaccagtgaagtcttagcaagtgctggaaatacaaataggttcacaatttaaaggggcagctggagcctcagtactccatcagtaatatgtattaagacatgccacagagcaaatgctcacagtgaaaagtgctggggagactgtacaggggtctactacatgtgattaaagaactgtgtcagatggcatttcaacagctttgtaagtgatgacagggacacaggtaaagttgaaaaatcacattcctatcctccttaggacagatagtaagcatacgtttttaattactgtcatgagtcgcttaaccacatggatacattctgagaaataggtctttgtgtggacatcacagagcatacttacacaaacctagatggtatcacctgctacaaacctagactggatggtagagccttttgctgctgggttaaaaacctgtacagcatgttactggactgaatactgttggaaaccataacaccggctgggcgtgctggttcacgcctataatcccagcactttggggtgctaaggcaggcggatcacttaaggtcaggagtttgagactagcctggccaacatggtgaaaccctgtctctactcaaggtacaaaaattagctgggtgtggttgtgcaaacctgtaatcccacctacttgggaggctgaggcatgagacgtgcttgaacctaggaggtggaggttgcagtgagccaagattgtgccactgcactccagcctgggccacagagcaagactctaccagaaaaaataaaaaaggaaaccataaaacaatggtaagtagatgcacaatgtctatctaaacacatgtgaacatggaaaaggtacagtgaaaatacagtataaaagataaaaaacatggtacccctgggccgggcgcagtggctcatgccggtaatcccagcactttgggaggccgaagtggatcacgaagtcaagagattgagaccatcctggccaacatggtgaaaccccgtctcgtctctactaaaaatacaaaaattagctgggtgtggtggtgtgtgcctgtaatcccagctactccggaggctgaggcaggagaatcgcttgaacccaggaggcggaggttgcagtgagccaagatagcgccactgcactccagcctggcaacagagtgagactgtctaaaaaaaaaaaaaaagaaacgtacccctgaataggacacttactgtgaatggagcttacagtactccaagttgctctcctgattcagtgagtgagtgaatgtgaaggcctaggacattattgtataccactgtagacgttatgaacactgtacatctaggttacactaaatgtatacaacaaagttcctcaataataaactgaccttggcttactgtaactttctgactttatacacttcttaatttttaaaactctgacacttgtaataacacttagcttaaaccacaaacacattgtacagccatataaatatattttcttcctttatatctgtattctatatgctttttttctgtttctaaatttgtaaaactttttaaactttttgttgaaaactaagacactgacacacacattagcctaacagggtcaggatcatccatatcaccatcttccacccccatatattgtcccactggaaggtcttcaggggcaatgacatgcatggacctgtcatttcctataacaatgccttcttctggaaatcctcctgaagatcctgcctgagactgctttaccgttaacttatttataagtaggagtatactctaaaatagcaataaaaagtatacaatatacataaaccagtaacataattattcatgaccattatcaagtattatgtactgtacttcatatgtgctatacttttatatgactggcagcacagttttgtttacaccagcaccaccacaaacatgaataatgccttgagctactacattgcaacagctacagtgtcactaggcgataggaatttttcagctccactataattgtatgggaccaccatcctgtgtctgtcatggactgaagtgtcattgtcattatacaacaccttactgcactcaaatgacctcctgcttcacccgtaaaggaaaatcatcatcagtgtagcctgtagctataggatggtgaagttcactaacttgccagccagtcactgtgttgaaatttggtagaacgtcatcctctgagccactcctaaatcttagtgggaacacaagtagcacaggataggctgacaactgaagtgaaagcagatagaaggaacttttcaacctctcttgtagaacaacatttcaattaccagagaaagtggattctctgggatgctacaaggcagatgtcagcctcaattggttaaatctgagaaacattgactgaatttctcaaaaacaacagggaatcctgcatctaattccaattcatgtttaaaaagcccagaaaattaagttacatacaataaggcaagtaatacattattaccattttgttgccactcaggattcaaacaaaagagactccaataaaccccctgttgtcaaatgcagaagatgaaattggcagagtgtcaacttctacagaaggcctcacttctcttccttgttctagctatttcctgcttgtcttttaaaattcctattacgtcttatggttttgaaaaatattttcctgacccctcagtgtgtccccactttcagccaccttacttacagtctgattcagaggttccattgttttgccctggtatgcaaaatggatgtctatcatttctcacattgcatgcaaacaaatattagtttacttttttctctcatattagaaatctgttaagggaagggggaaatacatatgtgtgtgtatatatacttatatttgtacacgtgcacatacatataagtaaatttgcttaattacctaggtgctgaaccagaatttcataaattatttgtggggatataatataagtacatgaggtaattcctacatgaaatggagtaactaacataggtcagcattaagttgccattaaaaagttccaaagtatgcattactcatgtttggataccatgtaacctgtaatgagatctgaattctggaaatacaggcaatgattacaggagtctaagaataaagaagccagcataagcctaaaaaataaagagaaggttttggagaagttggagttttgtttttaattttcatacatcttggattttatagcaaactcaattaactaattaaaaattagactcaattaactcataaaaaatgcatgttcttatgctgtgatcatatttcacaattgcagtttaaacaaaaccatgactcactatgctgacgttatgtcctggtgctgccacctatggacaccaggtcacagctccctccaggctggcaggcatcttgcagcatggctggaggatcctcccatgtggcctccctgttcctgatctcagcagcttgtttcccacaccttcaagtgtacatttcctcaggtcactccatagcatacaatcctccactgagtgaatccccatcacacatataaagtagattctgcagttgggggccagtgccggggctcatgcctataatcccagcactttgggaggctaagtggggcagatcacctgaggtcaggagtttgagaccagcctggccaacacagtgaaaccctgtctctactaaaaatacaaaaattaactgggcatggtggcacacgcctgtagtcccagctaccagggaggctgaggtggaaaaattgcttgaacccgggaggtggaggctgcagtgagctctgatcacaccctgcctcaataaataaataaataaaataaagtagattcctcctcctcttctttttatttgcaaaatattgcaaactcataaaaagttattaaaattgtacaaaaaactgttcttcacctaggttaaccacttgttatcaattttgtgagatttcctctttctgtctctacttacatataatgaatataacatagttattactatatgtataactgtattgttattgttgctatgtagcgtctgagttcttagagagtaatttgcaaacatcacgatcctttaccccctaattgtttagtgcctcctaaggaggaggacactgttaggtaactgcagtacaatcacgaagttcagctggtgcagattctgaatggaacttgcgagacccttcagaacgtggcccacctggcttcctctttccctgtctgcctggtactctttgtactttgcctaggaaagaaacggccattccttgctatcctccattgctttgtacacacagcccctgcctttcaagcatttttcccattctctttcctcagctgagttcactattgtttctgtgtctggacttgaatccaggctctggcgcttcgtagttatgggacaatggggaagttacttaacctctctggggctcagattcctcgtctgtgaaatgggattagaaaaagaaactgtctcctgggatttattgtggggttaaagtcagatattttaggtcaagagctaaagaatacctaggaaaaagtaagcattcaaaatctacttactgcccctatcacactaccatcatcaccaatcacttctcgggcctcatctttaacctcacacactccaggaaggcctcactgatcctcaaatatgaatccaatggcccagactgtgtgcttaggtaccctgcattaaaatgacctactataatttactggaagtattttctatttgtttcctcctagtttgcgtttaatgtcttttccacagtgactaagtctgacttggtcaattttgaaaggctagtattcagcatagtgcctgacacacagcaagattttaataactactcactgaatctataaatgaatttcagtaattcagaattcagaatgaatttcagagtctaatggccgaaataattttcccaaactcggctgacaattgatttttcaggggaagtccagataggttaagagcagaaaaggtgactcattcttcaggggctcaacacccattccccactgcccagggaaagtgtttgcatgccatgtgaaacttcaagcaagctagtttttaagctgttaaaaaaaatgagggaattaattgttctgagcagtttctcaccatctccacagcattaaattcaacattcgatttgcttttcaaacacagttaacaggcaggaagatgagataatctatttcagtgaaaatgtaaactgtggaagtaccctgtgagtaaactaggggagagagtccctccacaaacaagaaccacggctgcccgtggggaggctgggaacatgcccagaattcacctggcatcactgttgaggtcaaatgttaagacttgctgggaaaaaaatattgttgttgttgttttttggtgaatccagaggaaggaaacatattaaaattctaatgaatgactaaagtgaaaatgctttacaggcttatgaatgaaaattttcccaaatttttccttatataaagattatgcatacaaatttaaataccacaaaatccaaatataaaacaatttatgatgggctaatataaaattacactttttcaatatgatagaattgcatctttgactttatagaaatgttgtttaaaaatgtctttagaggtcaggtgcggtggttcaggtgtgtaatcccagcactttgggaggcagaggcaggcggatcatgaggtcaggagatggagaccatcctggctaacagggtgaaatcccgtctctactaaaaatacaaaagattagccgggtgtggtggcgggcgcctgtgatcccagctactcaggaggctgaggtaagagaatcgcttgagcccgggaggtggaggttgcagcgagctgagatcgtgccactgcactccacgctgggcgatagagtgagactccatctcaaaagaaaaaaaaatgtctttagaaactcctatttatatacaaactgatatctaaaggaagatccattttatacttcattagtgtaactttcagttacatggagttgtaactaagtgcattaaagatacaattgaacttattcccagatgtcaagtgtccctgccaagatttaaatccaatcacaatatgaatgatgtttaggagattcaatggggataaaacaaacaaacaaacaacatggaagacatcctccttctttgctagttgatgatgaagaaaataagggcagctactatgctttactaggcacttaccacatgccagacactgtgctgaactctttatatgtctcgtctcctccccacgagactcatttaaggtttgtatttattattcccaatttaaaattaagaacattggagctgagagaggtcaaatagctttctctaaaccactcagctagtaaacggtgcagtagaagctgaagtaagttctgtaatctattttaggaacttttcaaaacgaactgttctgtttgaaagttacggagagtctacctctaagtaaatgggagtggtgaacacttagaatgacaaggaactgccacttcgttcttgacctgtagaaaggcagtcggtgagggagacatgctatgatctattcggtagtcctaaaagagactcatacttatatacctaaatacgcaggtcaagacctgggcgaatttccctattatatattcctgtagctgagtgatgattcctttgtagcgggagtcgcagattcagtttcatctgtctgttgtggttattagactgaggtcatctccctcacttgacttaccctccaagaaaacagggaacttatctggcttggcgcacactgtctcttcagccctggagcactttgtaaagatgaagtactgaataaatatttcagaatgaatgcataagggaaatgtgtgttcagagggctgcagcagttgagttcttaatacatcgaccctttcaacacattcctggggcctggtgacctctaccaaggctaccttcatgttcgtcttatccctgttgcagcaatttgcaaattgaggaatatataatctagtgagttttaggtctggttgcactctagttgcagtctaagaaacaggtgaaagagcatattttaaaatgaaaacataggagagttctttgaaactgaatctaagtccaacaagcctacgagagatataactgtctttctctataagacattcaaatgagctctgaagtggtacaacaagggcaagtagtggcaaaccctgggaatcttctagcagaggcaaataaattcagcctttagagaaaatccctctaaattttgcttctcctttttaaaagacaataagttacattttgataaacaaggctcagataaatgagaacatttaattctaaaggatacctgttctagaatgactggtgggcagaaaattacagttttagatacttcgtgtgtgtgggagaagatactatacactaaaatgaaaaaaaaatacacatacacatgggagttgttttctagtttgccaatgatagtttgttaaccagtattttccttccttagtaatctttttataagtgaatttgtgtattctccaaacccacttgcatgtacatgcttttactcatatattttgaagaggattgcaaagtgtctgaagaactacgaaggagcttaatcaaaaccgtgaatacatcactacgtcttacatacaggaaaattaggcctccatatttttaagctgaaaaaatgctgaagaataaataaggggtaaagaggaatacaaacactacattaacttacagggtaaaataacttacacttataactagaatagaagaaaatcaaaagtcatgttaacaaaaagcaaagatgataatagagtccactttaattatatttgaattagaaaatggctaagggaaatgttattagttttaaaacagaaaagacatttttacgactgaaatttaaaagaaacatattttaggaaatcaatctaaacaataatttcatctttaatggaaatgagagtagttagaattttttaagtggttactaaaaaattactttgcttgaacttgggaggcggaagttgcagtgagccaagaccctgccactgcactccagcctgggcaacaaagtgaaactctgtttaaaaaaaaaaaaaactttacaaaaataaacagtaccatagtaaatgtctcaatgaaattattttagagtgaagaactttagataaagttactgaagaagcataaaaaatattagaacaatctgtatatcattgttaaggaaaagagtgaacaaggataacatttatgtttgcttactgttgtagaccaaatatttgttccttccccaaattcatattaggaaatacacctactatgatggtacccctgggagacggggcctttggaaggtgattaggtcatgaggatacaaccttcatgattgggattagtgtctttatgaaagttgccttctgctatgtaaggacataaggagaaagtggtctgcaacccagaagagagctctcagcagagcctgaccttgctggcaccctgatcttggacttccagccttcaaaactgtcagaaataaatatctgttgtttataagccatttaattgtgatattttgttatggcagcctgaatggataatgacacttattattaatatttgggaagatagggaaaaataatttatgatggttaaaaatacagatttgtaggaggaaataaagcacagctttgaaagacaaatcatactcgatcaggtaaattccctttatgactcactgtgtagattagaagaggcaggagatttaatatttcttagcttcataaagtccttggttttattccacaggatttagtcataaataagtgaatatatatttcagccctacaagaagttaagtggttccgtatggactagggtgggaggtgagataagatagaaaatataacaatcatcagaatatataacatataacaagatactatttgccagacgccatagtatagtatcttacacattatttcctggaattacaacagctgacctagtgaggtaggtgtttttattttaactttcacctaggaataaactgagggtcagagtgtagttaagaaacttgatcaaggtcacataagtcccaagtggcagggctgaaatctgttgatttttcaaagcatctttctgcccctaagcctttggagttaacatggggactcatgagagcatttcttaaaaacttgtcttggatctaattggaataggctcaagcacctcaaaaagttaaacacacaattaccaaataatccattaagtccactcccatgtatataccccaaaaaagtacaaacgaggactcaaacccacacttgtatagatatattcacagcagcagtattcacgatacccagaaggtggaggtactccaaatgccaatcaacaggtgaatggataaacaaaatgtggcatatatataaatggaatattatttggccataaaaagtaataaaggatttctatatatgacaacctggatgaaccttataaacattatgctaaatgaaaaaaacacaaaatcacaagtattatataatacgattccttttatatgaaatgtccagaatagacacaactatagagatggaaaatagcttagtgattgccagagactgagagatagaaagtagcttagtgattgccagaggctgggaagacagggaaatggactaactgcttaatgtgtatggagtattattttggggtgatgaaaatattttgaaactagatagaagtggtgcttgcacagcatgggaaaggtacttaatgctactggattgttaattctaaaatgtttagttttatgtgaatttcacctcttttttttttttttttttttttttgagacggagtcttactctgttgcccaggctggagtgcagtggcatgatctcagcttactgcaacctctgcttaccaggttcaagtgattctcttgcctcagcctcccaagtagctgggtttacaggcacacgccaccacacctggctaattttttagtagaaacggggttttgccatgttggccaggctggtctcgaactgaccacaaatgatctacctgcctcaccctcccaaagtgctgtgacataggcatgagccaccatgcctggtctcacgtcaatttttttaaaaggctcaaaacacttcctaaaattatgaagcccaagaataatgtctgcaacccatgaatgcataaggcaaaggaaataatgggattccttgttttcataattgaataaacaaggaaggtgttccctttgccttgcacagactgcattttcagtaaaatggaaaattgttggcaatgccactgaatttacctgttggcaatgccactgaatttacctgaagccagcattctctcttggacagaaataaaacaatgagccatactggggttcagacagcctgggttccagtcccagctcaaggaagaactaggtgaactaaggagttcacaacctgacatcttggtgtctgtttatttatccatagatgtgagtgaaatcaggccagatggatgaatgattgctacattatcttctaacctaaaaaaatttataagttaatattttatgaaatgaaacaaattgtgatttcatcttgtatataatagatacaataataaatagtgtccagaaagcactgggagcaatacattaggagtgatgtatgatgtgcagacaaaaatgagaagattgttcttcaaacattgtctggggacgaaacaagtcatcatggatcacaggtttacacaatttagtaatctacttaaatgcaacagttctcagtagaatatagcatttcactcttcacctacatggctgagtacctcgttgtaatactaaatgttcttgcccattgtagaaactcatatgtattgctgaataatcctgacactgaatcattgtggtaggcagaataatggctcccaatgatgtctatgtccaaattcaaaaaccctgcaaataggaatatgttactttacatggcaaggggaaatcaaagttgtagataataatcagctgatcttcagatatgatgaggatcctgaatcacttaggtagtagcaatataatcacaggatccttaaaaggtagaaggggaaggcaggatagtcagtgtcagagtgacacaagaaagagtccaccggctactgttggccatgaggatgaaaggggccatgggcccaggaatggcagcacctccagaacctggaaagcacaaggaaatggactctccctgagagcttccagaaggaacgtaactctgccaacaccttgatttttaggacttctgacctacaaaacttgaagataatatacatgtgttatttttagccactacatttgtggtaattggttatagcagctgaaaaaatatatataataggttgtttttgaatgaacgaatgaatgaactcatggatgtgggaggtcaaagtagacacggcggctgggcgtggtggctcacgcctgtaatcccagcactttgggaggccgaggtgggtggatcatttgaggttaggagtttgaggccagcctagtcaacatggcgaaaccctgtctctactaaaaatacaaaaaaattagctgggcatggtggtatgtgtctgtagtcccagctacttgggaggctgaggcaagagaattgcttgaacctgggaggtagaggttgcagtgagcagagatcacaccactgcactccagcctccagtccagtagacatggcacccagcacccccagaggcattgtgtgaagttccaagaaggtactggaaggtgaatttgcatctatatctatcccttgatattgaacttcccagcctccaaaattgtaaaaagtagatttctttatcaattacccagtctgcggtattctgttatagtgacacaaaatgggctgaggcactgaccaacaaaaattgtcctgagaaagacaggggcacctattttaataatggcatgagaacaaacaccattctgaaagaaagcaaagggtttctctgagttttaaaagcacacaaaatatttaataatagattataagtattgatgatgaagactacttatggattatttgtactttcccctatggaaagcagaaagattttaactatggttatcaaaatatattatgataaaatgttggaggagaatttagcacaaaactgtgatttcaagagaataaaatgatttaatttcttaccgattaggagattgtagaggagaagaaaacaattcatccatcgaaggcaatgctatcatggagtttagcaggaacttaagtgaatgctttagtgaaaatcatcaaccatatgtgactactttaaaaagcctaaaaatgttttttaatgctaaagttcacagaaaataaacttctaatcctttaaatatgttagattaaaatatttttattataaaaaattcagaaatatttaaaaaaatctcagttaacataattaagattaatcttggcaatgtgaaaaaaacacagttgtcttttctctgatgtatcgtgttaattaaaaagcaaacatacatattgttttatgttgggttatgtttccgaaacagttcaaatatgcttcctcccacataatgtttaagatcataaaaaatataaatttttgttcattgaatatttatatttttatatcaactataattatgttttccagaatatcaccttaaaaatgctttccaagatctttaggcaagttaaaaccttgaagtaatattaaattaattgaaaatcatttgatactcagaaaatttcaaagtaagataaaaagaatactgaaacattaactactaagcataattttaagtttgtatacttttatttttatttttacatgctcgagggaagccaaatctttagcttatgttaatgaccattttcatttttgccactttgcaaagcgaaaaaaggatgtgtgtagctataaaaaaattatgttttatgtgtctctgacttctgctagtcagctagaatgcttatgtacaacacacaatctcaattatctgtcaagtatcttgctgaaatagcaattatagttatatagatggttacaactatactagcagaaagagtgagagaaaaagaaaaacatatttatgcttttttttttcaagaacaaagactggtttttgaataaagcagcagttctcaacatcttttctctccatccagtagattcttaaaaattactcaggaatctaaagatgttttgtttctgtagtttataatgtgggttataagtatcaatatttgatgttttaaatcactaaaaccagccgggtgtgatggctcacgcctgtaatcccgtcactttgggaggcggaggcaggcggatcacctgatgtcaggagttcgagaccagcctggctaacatggtgaaagcccatctctactaaaaataaaaaagttagctaggtgtggtgatgcacatctgtaatcccagctacttggaaggctgaggcaggagaattgcttgaacctgggaggcagaggcagcaataagctgagatcagccactgcactccagcctgggtgacagagcgagactccgtttcaaaacaaaaacaaaaacaaaactgagaaaataaaatatatatttattaatgtattgggaaataacaatgttgactccattagataataatgtaaataacattttcttaaagaaaatttgtatgagaaaaatgacaaccttgaacatttttacaaaaatatcctgaatgtttggcttaatagacaactgatgggttttcaagtctgcttctccatttaatctcttctggtcatatagcctctgaaaaactccgtagcttagtattgttatgaaaataactttggtgtcacagttcccctgcaaacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtttctgtctgtcctacaatgtaaatgaagctcacagttcccctgaaaacatttcagggaaccccagaagtctttggaccacactttgtcctaaagcgtctgtctgtcctacagtgcaaatgaagtacaccacttggagagtgaattggacttgtgttggtttataatgctgatatggttaggctttgtatccctgcccaaatctcaccttgaattgtaatccctgtaatccccataatccccaggtaacgagagagaccaggaagaggtaattgaatcacgggggcgcttcgccatgaagttctcatgataatgagccagttttcaggagatctgatggttttataagaggctcttcccctttccctcagcacttctctctcctgtcgctttgtgaagaagatgcctgcctcccttttgccttccatcatgattgtcattttcttgaggcatccccagacatgtggaactgtgagtcaattaaacctctttcttttatgaattacccagtcttaggtagtatttttatagcagtgtgagaatggattaatacaaatgcctacatatatctaaaaagaaactacaaagatacatcaacatcaaaattttagcaaaaattacttaacttcaatgggtttgcttcattggtttactgattaggccttgacccacaatatgaaaaaatgtccagtgaaagcaaattcctctgccttctgtctaatctgcctacagagcagagattctgtgtctcatcagaatagttttctgtgattttagatgactttattatgcccttgattatttaagggcaaaaaatgttgcctcacttaaggaagagctaagattctttacaattgtctttatcctctatgttttatgcttgtattttaaatatatgttgttactttgagagacaggttttttcccctcacttattcacgatcctgtattaatctagtaaaacaatctcctctgacaattattaattttaacttcccaacattgaaccccaaatttagataaaaaatagaagtttcaggatgtttttttctccctaaaactaactttgagatctcccaaatggccctggaaaatcaccaaagcttgttctttcaacttataaatagatgctagaaataattaggtctgtctaatgtgttattttaagagttgcacaggaagaattttcagatctgaagaaacactagcctcctctaggttaagtttgcaaaatcttattactataaacatttcagaaattgtatgctttatggaaagtctctggtgccctttctgcccaccatatgaggaaacttcaaaagttcacagaaaatgcatattatagaaaaactacgcatggattccaatttttgtgccaaaataaactcatactaatttgttacaatgtgtctgagtaggatccagtttgaggcactaaagaggataagatggtcaggtgtggttggttgctcacacctgtaatcccaacactttggaggccaaggagggtgaattgcttcagcccaggagtttgagatcagccttggcaacatggtgaaactccatctctactaaaaatacaaaaaattacccaggtgtggtggtatgtacctgtaatcccagctactagggaggctgaggtgggaggattgcttaagccggggaagttgaggctgcagtgagctgagatcatgctactgcactgcagcttgggcaacagagcaagaccttgtttccaaaaaaaaaaaaaaaaagaagaagaagaagaaggataagacgtgagtatgaaaagagtccctatcagagcaacatgaattctgctaaaatccaagcaacttacagtgaaacttaggtgaaaaaatagtgaaatcactgatgtttcttgaaaattttataacgacaatgccccaaagaaatgagcagtttacaaattgataactcctgtttagaagggatgagatgatgttgaagaggaagcctgcagcaatagaccatccacatcgattcacaggtgaaaaattcatcctgtttgtaccctaactgaagaggaacaatgactaacagcacaaacaatagccaatgccatagacttctcagttggtgtaatttacacaattctgagtgaaaaattaaagttgagcaagctttcctcttgaggggtaacaaaactcttgtgcctagattagtgacaaaagtggagctttcaatggaaattttaaacaaatgagatcaacatcctgaagtatttctttgaagaattataacaggagatgaaacacagctttaccagtacaatcctgaagacaaagcacaaccaaagcaatggctaccaaaaggtggaagtggtcgtcaggcaaaggcaaactgatgaagaacaaaggtcatggcaacattttttttttttttttttgagacagagtctcgctctgtcacccaggctggagtgcagtggtgtgatctcggctcattgcaccaccacctcctgggttcaagcgattcttctgcctcagtctcccaagcagctggggactacaggcgcatgccacaacacctggctacttttttgtatttttagtagagacagggtttcattgtgttagccaggatggtctccatctcctgacctcgtgatccacctgcctttgcctcccaaagtgctgggattacaggcgtgagtcaccatgcccggctggtaacagtttttgggaggctcaaggcatttttgcctgttgactttatggagggccaaataaagaaaacgtctgcttattatgagagtgttttgagaaagccaaagctttagcagaaacatgcccaggaaagctccaccagagactcctcctgcaccacgagaaagctctgataactcttctcattgaggaagggcaaatatgcaagtttcaatgagaaattattaggcatccactttacaatcctaatttggctccttctgacttatttttgtttcatatttttttttttttttgagacagagtcttgctctgtcacccaggctgaagtgcagtagcgtgatcttggctcactgaaacctccacctcccgggtgcaactgattatcctgcctcagcctcccaagtagctgggattatgggcgctcaccatcatgcccagctaatttttgtatttttagtagagacagggtttcaccatgctggccaggttggtcatgaactcctgacctcaagtaatctgcatgccttggcctcccaaagtgctgggattacaggcatgagccaccacacccagctgtcctaaatttaaaaagtgtgtaaagggtccccatttatcttcagtcaatactgtaaaaaagaatgtactgatgtggttaaatgccagcagcctcagttccttggggatggactaaacggctgctatcatcacttacaaaagtgtctggatcttgacagagattatgttgagaaataaagttacatttttcatcttttaattccattttttttccacaaacattttgaagtatgcttacatgttcttactatcaggagaaacactgatatcaactcatatacaacagaaaattttattctccaaactgaaagtattggtcgcagcagtaatttaacaacagcttttaagtctttatcatctatagtcacttgtttcactctgatgcttttctaaggctttgctttaaggtacagaccacagcttgtgtcttcaacaaaagacagtttcagagatttttggaaaagcgctctgaactactgacatttcaaacagttatctcctgggcatgggtttctgagctgagaatgcttagacaactttcagatatatcagtggactatgttacgatttctagaactctttttagtgaaatcagattattaatctaagatccagcaggagaagaattaattatttaggactgaatgagctgatgaggaaaactctgttttgtttgtttgtttgcatgatgttgttgtaatattccattttctagatatatgacaaagccttttgtctttcttcttaaactttctatcatgtacaagaatctagtagactccacttttctacaatcaaacgaaacatttctaaatgatccctgatttttactgacactccagatttcatacattcttcctaaatttcattacttttcatggcaatgtaatagtctgcacagaaatcagtaaaaatctgtcctactttttaccagaaaaataattggacaacctaggtcaatataaaataaattgggcaacctaggtcaatataaaataaattgggcaatctaggtcaatataaagcatcacatttgagaatggttcttatttcatcagatctgacattctgctcttaaggaacaactgttgattttgcatgggtccacagaacactctcagggaaactggcttaccaggctccagcgatacagatgggaagacaggtaaaatcctggcacattagaagcattaatacattttcaggacttcaagagagtttacccaaatttacatgttatacaggtataacctagtaaagacagccttgagcttagttttatagtcacagaataataaataagagcaattttaaaacacaatttgaaattccttataaaaacatttgtggttttagtagttacattgtatggttctagatggaagaagtaaagtcaaggaggcctatatagtaaattaacagtcctaccaccaccatataactaattaggcccaaacaaatgagtccaatattttttgtgattattaaattttgagattattataatcataaattgggatagaaagtaagaagaaattttgaaggacgttgaaacgaaagaaacaagatgagtgggtgtgttatgaaatgccaatcctgtcatctgatttatgggtatgtgccacttacagtgtttgagccactgtataactttaaaattaatgcaaattatttgtgtctgtagagacacaaatagattttgtctatgttttagaaatgtgagtgattctttcctcctcaacaaaaaccactttgcatttattgtcagatacgtttcagcatttgtgattgcctagagatgacttccctttgcaattcctttgaactggtttttaacatctgactagtttcctcaaaatttaaataaaatctttgatgtgttcatttatatttgcctgagagtcatgactttgttttaaaaaattatacttttaacaatttaaagaaatcaatattaggggattgttcttgattttgaaaaggaaaaactaagaatatcaaccaacttcaatccaggactgctcagaagctggatagaaaaaataatgaggccaggcacagtggctaatgcctgtaatcccagcattttgggaggctgaggcgggaggatcacctgaggccagtaattccagaccagcatggccaacatggtgaaaccctgtctctactaaaagtacaaaaaatggccggatgtggtggtgcatgcccataatctcagctactatggagactgaggcaggagaatcacttgagcctgggcggtggaggttgcagtgagctgagatcgttccactgcactccaggcctgggtgacagagagagactctgtctcaaaaaaaaaaaaaaaaaaaaaaaaataccgtcgtcgggcatggtggctcacacttgtaatcccagcactttgggaggccgaggcaggcagctcacttaaggtcgggagttcaagaccagcctggccaatatggtgaaaccccatctctaccaaaaatacaaaaattagtcgggtgtggtggtgggttcctgtaatcccagctactcgggaggctgaggcaggagaatcatttgaactcaggaggcggaggttgcaacgagatgagatcgtgtcattgcactccagcctgggtgacaggagcaaaacctcatctcagaaaaaaataaaagaaaaaaaggcagatgttaaaaacaatttcaaaagaaatgggaaattttaacatggtttatattttagataaaattactaagtaatttttttattttaaaaaattaataaacagttttcttaggggtaaaattggtactaaataatggagttattctctttttttttttgagacagagtttcgctcttgttgcccaggctggagtgcgatggcgccatctcggctcaccgcaacctctgtctcccgggttcaaacaattctctgccaccatctcccaagtagctgagattaagtcatgtgccaccatgcccggctaattttgcatttttagtagagacggggtttctccatgttggtcaggctggtctcaaactcctgacttcaggtgatccacccaccttggcatcccaaagtgctgggattataggcgtgagccaccacacctggccaatggagttattcttaggccatgcttgctgaagtattgaggtgtctagtatcacaaaatttgcaaatcatgttcaaaaaatatagcaaaaaaaaaaagaaaagaaaagaaaaagaaaaaagaaagtgtgtctttgtgtatgagcacaaaggaaaagaaagaggacagagccattgagaccacctgttaatggctggtgccagcaaggtggtgcctccatggctgctcaatgttgatataatgttgatgtctctcaacttctcttgaagttgaaaattttcaaaataaaaatggggcaaaataccagagagaaaatttgcatttatttaaaaaacactgagcattggttgagagttttagaaccagaggacataaaggttcttgataacatatgtatttttcattcctcagatccctagccagtctatactcctttgttccagacacactgataagagaataatccaacttagttcatgaccataagttaatgattatttcagatcctgaaaaagaagagccggaaagtgactgttcagaaatcagaatgtctatgtggcatgtggcaagggaagaaggtacattcaggctccctgcaggcgcacaatctacaatgcaggaccacccatttccagtctctgtgatgctgaccacagcctcttagagctggaactaatagcaaacctcacttggtgtttgtggtctcctaatgcattaggttctccccgcacacaccatgaaattcatcagtactaactgctttggacacagaatattattactgacaggacagaattgaaagaggccatactgatatggaagtgctgggaagggaatggcatggtcgctttaaccaatatggaaggtggggaagggaagtgctgggtagaggagggcatggtccctgcctagggctccactcttgggcctgtgcccagggacctaggtgtggacaattattttcattttcctgccccaatgttggcatttcccaagaccaccctggccttccacatccccatcctgtgcctataaaaaccctgagagcctagcaggcagacacaggcggctggacgttgagaggagcacatcagcagaggaacacaccgggggctggatgtctacaggaacacaccaacagccaccagcatgttggccactgactggcagaacgatgtggagtgtggctgaggcagttggaggagatcccaggctgctgagcagcccgactccaggtgaaaactatctctcttctggctcccccagctgctgagagctactcaataaaacctcactctcattctccaaggccacttgtgatccgattcttctggtacacaaaggccagaaccctgggatagagaaagtcctctgtctttgtgataaggcaggggtctaattgagctaacacaagctgtctacagatggctaaactaaaagagcaccctgtaacacatgcccactggggtttcaggagctgtaaacattcacccctagacactgctgtggggctccaacagccctgtctgtatgctcccctagagcagccgggcactaaagaagtgagccacgcccccatgacatgccctgggaggaggacaaggaaacttcctgtttcaatacctggttataaatattgctggagaccataataaagagatggatcatagaggaaagatcatgtgaaaaaagggtgagtgtacaattttagggtaaaatagaaatacgttattaatgaagcaggaggtgggtgttttaattttggtccaagttttcagttaaaactttttgcttataaaaataatatctcccaaaagcataagtgggttcttgcatgaacagagaagaaaacaaagatttacattcctataaattacagacaacctgaaatatggccctcgagctaccaaatttactaaagcacactggcagtcattaaaattgcagaacattttacttcagtggtacaaccacaggggcctctggggaaaggctgggcattttactcaccaaaacaactcattggaactaaaggcatttaaaattactccactcaggctgggcgcggtggctcactctcaatcccagcactttgggaggccgaggcaggtggatcgcctgagatcaggagtttgagatcagcctggccaacatggtgaaaccctgtctttactaaaaatacaaaaattagctgggcgtggtggtggatgcctgtaattccagctactcgggaggttgaggcaggagaatcgcttgaacccaggaggcggaggttgcagtgaactgagatcgcgccattgtattccagcttgggcgacagagcgagactccatctcaaaaaaataaataaataaaataaaataattccactcagcaagattttgttgttggatacttccttttgttccaattcaaatacagtgcatgacattggaattgcaaattgctcccattatacctacctgaaatgaaaaaactcaagagatttgaccaagaaatatgaacacctttacatcaacagagtaaatgggagaagactgttcatatcatttatttggaaacgttaaggttggaaccacaatctaacatttgacagaaaaaaattatatcagagatctgtaataaaaaatacagcatatacccctttaagagtaggcaaaaagagaaaatagctggagtatccaacaggagatattttgaggcaaaaaatttaaaatagacatttgcaaagatgatgattagggaagatggttttcttctaaagacacatgcagtgaagaaagaaatctttattcttatctgggttgcaaatggcactttttgcaaaagaactgctacttacttctagagtcagctaaaatgatatcaaacttttttaaagatgccttcttaaggcagaaagtgtcttaatttagttttaagatattttaggcttattaacctcaatagtgaacttgaagattttccattaaatccactgtccatcagcctattatagacatattacaattctcctcccaacatcttgccttctttatgaagttgacgcgaagctgaaaataattctgtcaaataagacaaaaaaaattaacaaaccacaaaattctatttcatgtcattcatcaaatgctatcaatacactctgtgccaagcactgggttagaagagaacaatgatattatttgtcatttattttaactttatctaattcattttttataaatgcacgagtaagtatcttttagacatgaaatgtaatatgtggatagtatgtatattttgaaggaatataacagtttaatgctattttcacaaatgattattttatgctttaaagaagtttttggtaagtgaatgtggaaatcctgaaataaagtcaaatgatatgatttgcattttcccagcagcctctaaggaagcagcctgagggatcagcctgaggaaataccctgagggatcagccttgaggaatcaggtgaggcatcagcctgaggaaataccctgagggatcagcctgagggatcagcctgaggaaataccctgagggatcaacctgaggaagcagcctgagggatcagcctaaggaaacaccctgagggatcagccttgaggaagcagcctgaggaatcagcctgaaggatcagcctgagggatcagcctgaggaagcagcctgaggaagcagcctgagggattggcctgaggatgcagcctgagggatcagccttgaggaagcagcctgaggaagcagcctgagggatcagccttgaggaagcagcctgaggaagcagcctgaggaaggagcctgaggaagcagcctgagggatcagcctgaggaatcagcctgagggaccagcctgagggatcagcctgagggatcagcctgagggaccagcctgagggatcagcctgaggaatcagcctgagggaccagcctgagggatcagcctgaggaatctggctgcagggaaaatagaagtcctatcattggactttatctcaccttctctcaccatgttctgtattgcccataatctgttttttgatataatttcaagatactgtccctgaaactctgcaatggggggcttaaggaatgtgatagcttgacaaaggtttggaggagggtttccaggataccctgtagtgctctttcaactccaggtcttaaacagggccacattccctgcaaggcccggcacagaccccatgctgaatacatagaagctgcttattgccttgttgccccatcaccatttttttttctgttctgcctccttcttggggccattgaaggttcctcagcattgggctccaaatcccttctctgtccttcccacccacttctgtgctaagtcccagaacctggtattgtcctttcccctagatgatgagtctctgagcctgcagactgtctggatcactttctgggggccaagcacagtgtctgctaagaaggcgatccctgagacttttattttattatctaaataaaaggtgaaagaatctgtccaaaatagttgctttaggaattgtactccttataaagcaaagaacacactgtcacagaattgattttatcatagtcatgaaatctatgttagaagaaaacagccctttttctcagccaggcagagactttgaagagttaacttttactgtatcacagtggcctacttaatgctatacaagaacacagaatacatgctgtatttacaaacttcaaaggaaactagctatttgcatttttatctgtaggagaggagagaaacatgtttcctttttgaccttttatcctcaagttatatatgaggaagattaaatttgtcagtattgtcagtgtaatctatttagggttttaaaccataacagtggaaaatatcaagattgactttaaagcctactgaatataacttttttaaaaaaaagctggatgagacgctgaaatggagagaaagccttagttatgggaggccggattggaagtttttcaaaataagcatcagaaataatgggccccctattgctcacatgcagacatcaatcttttgtttgtcctggcaaggtgagaaaaaaaattgggttaccatcaaagccaggtaatacggcccgctcatttgtaaatcacatggctttagtaagcaaagatgcttcctagatttaatgaatgtggtatcagaatgttttctttgaatgagtacagtggtcttctatccggttttcttccttccatatatctgtctctttgaatgacaccaagtggattaatcttcctaaagccccagttgggaaaattatcattctgccttctcccaagctttcaaccattcccactatatgccaaataagctcgttatgttgcattcaaagccttctaggacttaacagtaacctatctttctttttatctcaaatttctctcccaggtacaccaagttgcagctaaaccaaactgtggtttgttgcctgtttctggatctttgctcattcttcaccatcactgataatgttctctctaccccctacctttcaaaatcccacctgcacttcgagattcagttcagctcacagatccatcttgaagctagacatgacagtttccctcttttgcagtagcagagaaatatgtttgtactcacaatatgtgtcacaccctagattttaaagctcccgaaatggatgagccttcttttactatttttatatctcccactgtcctgccaaggacgaagaaatattttttatatttctatatattattcctactataaattccttagggtgatgagaacttccttagggtaaacacctagtttttggtattatacttatcccttacagtatttagaatttatttagtaaatgcttaataaatattttttaactaaatgagtagaaaccgtagaatgagtagaaaattttttcctaaaactacaagtaggaattttgtctatctcagagacagcagaatatgcttagtatttcaataaaggacagttttttagaataaatagcgtactttggaagcctgaaatagctggaaaagatgaagtttcttatttattatgcctctggatgtgtttttaatttatttccctagaagagctcttaggcaaagtgataacttggcttagaatctttaggagaaataaagatgaaaataaatacggttctttaccaaattgcatgcacatcacacacacacacacacacacacacacactctctctctctctctctctctctctctctctctctcaatacaaaagagacagcgctaaccctgtcttgaatccatagaatcctcaaatgcatgcatttcagagtattgatggtgacactgataaaacattcagaaaatgacttattctgaatctgctgaaggggtgtcctcacagtgaatgccttcctttccttctgagatccaccaaaaaacatactagtctgttcagagtgatcttagaattcagttatttttatggcttggaaaatctactcctggaaatctgttctttagaaatactggcaaggctgtaaagatacatgtacactgctgttaatcccaacatttggagaaggaaaaaaagtaagcgatctcaatgtctactaatagagcaaagctaaataaattacagtacaatggaatgtatactctgcagccgttgtgataaatcaagtatgtccataggggtccttggttaaaaggctgtccatgatgttttattaaatgtaaaaagcgcgttgcaaaagatggggaaatacccaaattgctgaacacttctgtagatctcatttttctaagagtaatattctatgtatctatgcacttatatttatagacaggcatacatatgtataaatttgagtacatatgttgatgtctgcaagtgcttatacatctgtttatgtgtagatgtatgtataaatgtttatacgtgttatatgtaaaatatataagctatatatatatgcatgtacatacctttatagatatttttacagccatagataaaaagatgtagaaagattcagaacaatttagaataattatctcttttattggcttaaaggagggaaaagtgaacttttattcacttaatagaaaaaaagaaaaaagtagcagaagttcaaaactgtggtgtttaatttgggggcctgttctgattcatgaatcagatttgaaatatacttgaagccttttcttaaaaatggtcattcttctgacttgatctgcagactttattgattccaaatggttcacaatgaggctgtgttctgtcatcttttacagcaattgttcctactttcatgtatctgcctgtgactacaggaggcagcggcttccccagaccactcacctccctccttcacacctgcctggcccgagtcccacagtgatacctgtcatggaactacatcttgtattcatgtgttaaacagagctctgtagttgattcgcaagaaagaaagttcctttcagtgaaacagagttgtagcataattgttgttttaaaacggtatttttcacatcaaaagatgatttaatgtagaattattttttaaatgagctgccttcatagatttaaaatatactttaacaaatatttgacttactctcacatacttgacattacctaatatgtaccttgtacaccttttttatggattagagtttgaaaccaaaccagaggcaccttctgttatgccatcctctgaaagcatatttcaggctgagaatatctattttgcattttcttattatgtatcttgagatgcaatttctttcttttcttcttcttcttcttttttttgagacagagtcttgctctgttgcccaggctggagtgcaatggtgtgatcttggctcactgcaacctccacctcccaggttcaagcgcttctcctgcctcagcctcccaagtagctgggattacaggcacgtgccatcatgcctgactaatttctgtattttttagtagagaggggatttcaccatgttggccaggctggtcttgaactcctgacctcaggtgatcctcccacctcagcctcccaaagtgctgggattacaggcatgagccaccgcgcccggttgagatgcaatttctataacagccctcaccaactattttaggtcttcctgctggactcatttgctcatttattcagcagatagttactgaatacctacctgcttcctgccactcacttttgttaagtgctggggatacagatgtgaatacagtgaacatagttcaagtctactgaggcaggcaacaaactttcatcctacagtctcctaaataaaggtagactagcacattgcattatgacacatgaaagaagagtaaagaaggaggtgagagttgtcacaggctgcaagaatcaggacaaggaactgttctctgtggaaaatcagataaacagagacctgagacctggacaggagtcagctgcatgaaaaaatgcagacaatttctctggccatgagacatgcgaaggccttgagatacagaaagatttggaacttgcttaggaatgggaataaggcccatgtgtttggagggcaagaggggacccagacacagagccgtgtcagtaagggcacatctgagtaaggctttcaagaagctggcatttcaacacagatccttctggcagtcagtgtgcatttaccaaatgggcctgccattatccgtacatgttctcatgtagtataaaaagtcgcaggaagctttttgggaacttgccccagaatttccacaaaagcagagctctctgatttctacggggaggcagagaggctggagggaagtggaccagtgagaagtggactgcagggctgcagggaagcctgatcaacacgtgggctccaggctgctggatgaacagagcctggggtggacttcagcggggtagttccatgcaggacatgatccacacaacgctatgaagtcctgttccctgcccagagccaccagaagtatcttcctaaagcataaactggtcactctgttctcctgacttaaaaactccaggctgggagtggtggctcacgccagtaatcccagcactttgggaggccgaggcgggtggatcacctgaggtcagagttcgagaccagcctggccaacatggtgaaaccccatctctactaaaaacacaaaaattagccgggcattgtggcaggcgcctgtagtcccagctactcgggaggctgtggcaggagaatcccttgaacccaggaggtggaggttgcggtgagccgagtttgcgccactgcactccagcctgggcaacagagcaagactctgtcttaaaaacaaacaaacaaacaaacactccaatgactccctgatgactaagtgatagagttataactccttgaaggacacaggaggccctctgcaagtggatcccccaaattctttgtctacttttacttccctgagatataactacagcttacttcctaccccatatgggccaagacagagcactctctgtgattcagcacatgggattcctcttccagggatgactaaccacctcctctgcatggtaacctactgctgataccacaagacagcctgctgcctctgtcctcctgattccacagcttttggagggcagcacacggcactggggagaacagcgggcatgcccctggctgtccaggtcagctcaatttaactggtggtcagtggcttacagatattggtaccagctatccctaacagctaaactctttgcaaagcatctcctcatggggcaaagtaaaaggaaggtgggagattgggaaacagttacaggtaactaaaacagcatgtgccaaggtcctgtgctgttttgctcaatgaactggagaaagaccagtgtctggaatgcagtgtgaagtaagaagaagccaacagtggcaggctctgattaaggttttaagaagtgcaactatcttttgcttttacaaaatattagtggaatggtgactgatggacatccccgtgaaatggcagcagacaacacagaaaacatgaatggacccaaccatatgttaaattggttctatctttggccgggtgtggtggcttatgcctgtaatcccagcactttgggaggccgaggtgggcagatctcctgaggtcaggagttcaagaccagcctggccaataagacgaaatcctgtctctacaaaaaatacaaaaattagccaggcgtggtggtaagcacctgtatcccagctacttgggaggctgaggcaggagactcacttgaacctgggaggcagatgtttaagtgaagccgagattgcgccactgcactccagcctgggcggcagagtgagactcagtctcaaaaaaagtggttctctctttgcaatagcaaagagaaagaaaacaaatggttacaaaaccaaaatacagtaggggacactgataaaattcaatttagcaaattcttcctggcctgtgaacttgctaagggtatggcgttgtagggactgtgaaagatgaatgggacctacagactggtttatcaggtatgagggaaacatttaaatatttacacaaaatgcaatggggtttcaatataaaagaaggttcagaaggcatcacagaacacgtgaaaattgtactgcgtcttcgagagttgtaaaagcctcaggcgaagggctagaagagggagtttcaggagaaggaagggcagcagagtgaagacactgaaacaagaatcggaatggctgccctattccaggggcattgagccatgtccctagagcaaaacgtgtctttttagaaagaaagaaaatcatcaataaattataatttttttttacatgtcaaagaggaaaggtacgggtgttaagtaatcagtctaaaaaaagttttggggcaatttcaatatttgttcataagaattcatgagtagggtttttacgttactattactttaagttgctgtaggcagaatttagcttgaaggaaatttaagatttcttgataattaaaatacgaaacagtatggcaagacaggctggggaactccaagtctgccttaattagatgctaaaaatagatgtttctaaaagtcctgtttcctttctaggccatccaacattctggagaagtgcttttaatctcagcaatgtgctaattgtttctaatggcctgtaaacaagctccctgaactattaaccttcttctctctttagccagagattcaggaaattagtctttgaaagaagagtctccagcaggttgcccaggagggtgtcccaaagtacagacactgtcactggtttggaggaaaatcaaggtcagatctgagcagcaagcttgtaatgtggaatagacaagctcaaaaccttaaaaagaaagatcactccactcctctctggtttagtttggttgtgttcctatctggaaggagaaatataaatgttaggctgggcacagtggctcacgcctgttatcccagcacttcgggaggccgaggcgggcagatcatttgaggtcaggagttggagaccagcctggccaatgtggtaaaaccccgcctctactaaaaatacaaaaagttaccttagctaggcatggtgacgggcccctgtaatcccagctgctcgggaggctgaggcaggagaattgcttgaacccagaaggcggagattacagtgagccaagatcgagccactgccagcctgggcaacagagcaagactccatcttaaaaaaaaaaaaaagaaaggaagaaggaaatgtaaatgttggcacctctccaatggcttccaaacacaaacacaagcccataatcccaggatttttaaaaaacattaaaacaatatccttcagttgacaagaatgttgaaaatttgattgtgctaagttaaaattgatgccatattgaaaatggcgttcaatttaatctcagaaaggcaatgcctacctgaaccctcggaaaggagctggggcattgagggtgccaccctctgttctgcttgtccttttcagaacatgacaaaattaacttaatttgtcatgaaagatgaatgatcacagagtagccaaaaaatgttgtgaaaaagatggtcagtgaagagaggctttatcaaacatatttcaaactttatttaaaattacaatagtcggccaggcgccgtggctcatgcctgtaatcccagcactttgggaagccaaggtgggcagatcatttgagctcaggagttcgagaccagcctggccaacatggcaaaaccccatctctaccaaaaatacaaaaaattagctggggatggtggcgcacatctgtggtttcagccagttgggaggctgaggcaggaggatcacctgcacccaggaggcagaggctgcagtgagctgagattgcatcattatactcaagactgggtgacagtgagactccatctcaaaaaataaatacatacataacataaataaaattacagtagtaaaactatgtgcctggcacagaatgagcaatggaacagaagtaaaagcctggaggggagaacccaagagagacagatatttatgtgtgatctcagcttataaaacctttccaattagtgaggtattagatgatttgctaaatggtattagaataatcaacataataaataataataaaagttggatctttttagcattcctcaattgaggtaatcaggaggatcaaagaatcacatgtataaaacaatgaaagggtaaaagtaggatgacgacgtgagtcaatcaagttaatagcccaagaggggccaagacatgcccacgtgagcagagaaaccaaaatccactgatcattgactacacacaaatgtaataattgatatggaaagacactctaaacagagtaaacatatggaaaagtgctagcattcctgacatctgaagaaatctcctgaatttatttatttatttatttagatggagtcttgctctgttgcccacgctggagtgcagtggtgtgatctcagctcactgcaacctccacctcccgggttcaagtgattttcctgcctcggcctgccaagtagctaggaccacaggtgtgtgccaccatgcccagctaattttttaattttaataaagacggggtttcaccatgatggccaggctgattttgaactcctgacctgggtgatccacctgcctcggcctcccaaaatgttgggattacaggcgtgagccactgtgcctggcccaaatttatttatttattttttaagacaaatatccaataggaaatttagggtggggggatggcaggtcaaaagaagtaattcacagaaggataaatacaaacagccaggtttaccgggaaatcacactcagtgtcaggggagcagctagccagcaaatggcccaacagctagcagcacaaccacgtccctgaacacctgccggatgccagccctgcaggtactgctgcaaagaggtgcccagataggataggtagaaacaagtgacacacacaagtcagagggcagcatgtgtgacagggtctcatcactacagcattctacacacacatgtacattccgaacacatcagcaggaagactgggcatcagagttacaagacaggtgtgagctagcacgacgcaccctgaatttcagatccatgaataagccctttcctacttataatcagtggtactgaggcagaatggggcgcacctaggaatacacactttagtacaaaacctgggcttgagaccctactgtaacttattgactatgtgacattgaattacattccaagcctcttcccacataagtcttggtgacttacgtgaggactgggacactaatagtatctacctcccaatgttattctgagcatttaaggaggccctgcatgtaaacacagttagcacgcactaagtttgggcaggaagagatttttcacagttgggtaaggcttccagcagatgcgacttggttgataggaatctcagccgtgtagctgaaacgtagcttctataatacatcgaagcgaagcacttagaggcatatggcttctgtgaatgtgctgcagcgctgagcagtatcttcttcatcagttccactaaagactggaaactcattataatcctggcaagactgaggtttagccaagaatgttctaataccacagaagctctgtatgccacatcactgatgccgccacagtgagacagaattcgaagtacagccagatgcttttagtaaggttctctttggcctgaccttttttccactccattcgccttgctttctgtgggaataattctctcaacttaaaattaccaaatagcattaaaaattctgcaatatttctgaaatcatattgacacataatggaggatttttcagaataaaattagatgactcttgtaattgttttattaaggaactgcaaacttgtttccattcttcctgaaattaagtattcatttccactgtaaggcaagaaaaaccagctaacattatacagtcaaagggtgacacctattaaacctgatcgaggtttttggaatttatttaaaatacagaactaaattacagtttgttggttctggaaaatgactttcagaattgctttatctctgtacaaccagactcagcctctccttcacagtgcaggcctcctaatcactgcctgtttaccatgaagcatgttttccagtattggctcagccagtttttcttccttcctttatcaaaatccaatggaaaagagccagccccatggctcaatgtgaaaggccaggagttcacatgcacaatcttaaatttggaactaaatgtatttctcttcagaccatgaaacaatggagaggaacaggagagtttggaatgtacatggtttaagcagtctcggaggaagtcatcgtcctgtctcacaaaatcattcctgggtcagccccacctcttcttccacctagagcaggctttcctgacctcagcatcattgaaagttgggcaagataaccctttgctgtggggctgactcgtgctttgtaagatgctcaacagcagccctggcatcaacacaccggatgccaggagcaccacccttcattggtgacaaataaaatgtctccagacattgccaaaggtccccattgggaaaaaactaccccggatgaaagccactaacttacagctatttaagggtattattatatctagattcttgcctcatgtcatattatcaaaaaagaaaacagagttacagagaatatttactaaattttacattatcataattatattcataaaaattacataattggccttaaaaacattattgttttcataggaaaaaaaatttcaattcaactcgccaaagaagggtttgtattaaaatttccttggaggccgggcacagtggctcacgcctgtgatccctgcactttgggagaccgaggtgggcggatcacctgaggtcaggagtttgagaccagcctgatgaatatggtgaaaccctgtctctactaaaaatacaaaattagccaggcatggtggcgaatgcctgtaatcccagctacttgggaggctgaggcaggagaatcgcttgaactggagaggtggaggttgcagtgagccaagatcacaccattgcactccagcctgggcaaaaagagctaaactctatctcaaaaaataaaaataaataaataaaatttccttggacagatgatatctgggatgtgaaagcatgcgtgccagtcacagtaaagattatatactctttcattatgcttcatagaaccatggctgtggtaagtttggagaacaaagtacagataagtcaagacctgttggttcaagtaaagacttacctacaatatccccctttcagttagcaagtcagggccaaaatcttggctaatatttactgtccatatgtgatcagcactgttcaagttttatctcttgtaattttcacaaccttttgaagaagttgagagactggggaacttgcccaggaaacaagacaactagaggtagaactgggttttgaacacaacattctttctccagggcctgtgctcttgattccagcctgttccatggaaaatgttcaccaaaggctaactcagcgggtgtccttgagcaccactgagccattcaagggcaaatcaatctatgctcagaaacaaatggaaatgaagactggaaaacaagaaaatcagatatggtgagaaactgggggaggagagaaaagtctgtgccttctgccagtctcagtgcaaaatcagtatggcataaaatagcacaaatggacaagaagcaagtgagagagtacagtgctctctcaggaaagcattccactgtatttatggaaaaataaactctctcaattaagccaaattttcaagataaaaggatagttccatccatctataatttagtaagggatacaacaataaatgttctgaaatttattctttaatttcctgaattaaaatctctctccatatggactaggagttgcaaaaacatatacatatatatgcaattatatatataattccagaaaaccagattagagttgaacagtgacacctatgtaaaaaccaatgtgtgtgatggagtcatcctatttcgtgcattttagcattttcctaggatactgttctatataaattctgtaatagagttatatataatataattactgtagctattagtgatttgaaaggccactttcttggaaaatttcaacttagtgttgtcaccggcattcctggtcattttctttgtgcatcctgtacacgtgtgcaggtgtactggactctgtggtcatgggaacctccgagtcttcagacacccgctggaagaccagccatcatcactcaagtctgcagccagctgcccaatacagaatggagtgagatggcaccttccttactgtcatacgtgtaaagtcttgcagtaggagaggatctgagagggagcagcaattccaggggaaactgttcattgataataacatctgaatgacatttgacagtttcctaagcactgtcacgtgaatgttgtttctgaactatcaccacaaccttgatactccttttaagtaggtaccatcaacatcatatgacagagaggtagctgagggtaagggtaaatgactagttcaagtttatatggcaagcaatcaactgcagatgcaaatccatgtctgtttttatttttttgttgttcttgttgttttttttttgtttgtttgtttgtttgtttttttgagccagagtctcactctgtcatcaggctgaagtgcagtggcacaatgttggctaactgcaacctccacctcctgcgttcaagcgatcctcctgcctcagcctccctagtagctgggattacaagtgtgcgccaccacgctcagctaatttctgtatttttagtagagacgaggtttcaccatgttggccaagatggtctcaatctcctgaccttgtgatccacccgcctcggcctcccaaaatgctgggattacaggcgtgagtcaccgcgcccagcccatgtcttctcttgattttgtttgctttctgttccaccatgccatgtttctgacagtatcgctagacaccactccagaccaccagcaaagaaagcagagggcttgcgctcagggggcaggtcctgaggagtctcctgaagtcctcccgtgcaggtcaaggctttcattaactacgcggatcaatttaaccatctctcttgtagaggagtactttaaaacctagtcaatgagtgctaatcacagaaatcatttcagattaatcttagaaataatcattaaataaatgtaataccctttaaaaaggggcataaaaacagattcaagttaagaaagtctagttgacaacaaaatgcaattccacatcccagaagcttactgaattgcattaagcttaggatgctaatattggatgtcatgtctctatatggttaaaatgcacaaagagataaagacgcttgcatttattttaaaaacttattataatacttgggtaatttatcagtgacgttgtttatttgtactgtggttaaatttttagcgcaataattgtatttcttaaaagacacgctaaattgttcctctcttcttatgcctgggaaaccatatgaagattcagtaggaaactaaattttgaagtttattccctaacttttctttaagatacattttgactatttgaatgttttatgttgttgctatttttaagggaatcatttatatcagatataatgagagaaatttaaagtaatttctacatcaaatcaatattatggtatttgtaaaaaataataataataattaaaactctgttttttctttgcagttgttttcattgtaatatgatacctgaattttatgtaagaatgtgagagtgggccaggtgcagtggctcacacctgtaatctcagcaatttgggaggccaagacaggtggatcacctgaggtcaggagtttcagaccagcctggccaacatggcaaaaccccatctctactaaaaatacaaaaaattagctgggcgtggtggtgggtatctgtaatcccagctacttgggaggctgaggcagaagaattgcttgcacccaggaggtggaggttgcagtgagctgagatcatgccattgacctctgaactgggcaacaagagtgaaactccatctcaaaaaaaaaaaaatgagagagaaaaaagaaaagaatgtgagagtggttagtttataatatagttaacatagttgaatctgactgttttttgctttcaaaacatgtattattccactaagtggtatcagttccctttgcattacagcagtcactggaataagttaaatattgttatttttgttatttcttgtccaaaaaatacacactgtacactttctcttctaatactgtcctaaacaacttttcgcaggattcactggttattctcctgcctgttgcccaagggctgtagaagatacagagagaagtaccacccagatcccgtttcaaataagtatttgctgctcagatgtgaggcgtgtggccagggatggcctctgctgtcagcatcggcacctgtccctggcagccgcaccgagaggctgagcgagctggggatctagcggttttccctttgcaggcctcggttccgacggataagataaactcacaccaacttctgcctcaatttctgcctctggagaagtccgcccataacagtctcctgccacagcctctgcagcagccacatataagaggttaaactctactaacatttccaaagcaatccttttagagaagtcttatctttcccaaatacttttctgtcaccaatgcccaatttcttccaaaactacttcttatacaattacgtgtccacactattcctcccattaatattaaaatatatttgcttgtagcaacatggtccctcctaactcaaaatatttcctctgaggtgatactcagggttagatactcccaaatgaataaatgcctcgtttctaaaaataactatttatgacatatatttcccgagaacaggattattaataatcataagtgatttagatttgtgtacagatctaaaattttcaaagtgtgttcacagaaattaacttatttgatcctaccaccacctcaggaattaaccaaatttaggaaattaaagtcacagtgattgatctgcccccagtcagacaatgaaatcggtggtgggttcaggagggaaagctgttcttatgacctccatcctggagtcatctgctttctgtgttacaacctgcacacctacagaccttctgcaaagtagaatgtgctccctgggggattggggtatatgatcctaaactccagggcttcagaatctgtaacttggatgttgccatttgaagctgaaatggaaagggagggctgtgctaacttggctccccgctttggtgccaccacactggaaaaaaaacatggttccaagtgcttactgcatggactcacttcatccttacaataactgcaagaacaagaagatgctcttattatctagaaggacagaggcaaaagatggcagagccaggttctgtacacacagtctggcttcaaaggcagggctctgaaccactgtgcttcatgtgtatcttgggaattggaaagacggctggagacaaacgcaaaagacatccaaatcttagcagtgagtaaagaatgaaaatgaaagggaaggcagaagcagaaacttctttagctgttggggataaatcacgcgataagaatttaagaattcaggggatgatttaagatcacctacatagtcacacatgtctataaataactcttggattaatggtctatgtatacttccatatttataagaataatgcaaatcagaagagccttcaccagacgaggccatttgaaagagatgggttttaagcaaactgggaaggtgatgtggagtgacgattagttactattagcaaaagggtcagtgctgcaatgatgtaggactgcagcttgctggggacagaaagtcaatctgtcttgctttgttagaacaagaaatgaaagtcagtctgtggatttaagaacagcaataccaactcctcacctacatggtagacagcttgcttttccaattgcagtttaggaacaaagggaaggagaattcactttgtcacagaattttcactaatgaatatagacaccaatgcaggaatatgtgttatatttgtgtgtaaccctaatcactattacctatgctacctctcctgaaccccagtggctgtggcactgtaaaatgggtataaataacattcaaaatgttaagataaacatacatgcaaaatatctaacaaatggtaagaacaacttgttagcaatagttggaccttctccagccttgtggaatatatactgatgtcacattatcctgacgtacacatgtgtctggactgagcgcacaagaaaacagtcctgtgcagtctggaacaccacaaagtcacttttgttccggctcagagaaggaatctaatgtggagacctgcaatgatagcaacaggtgttcaagtttgactttgtggtcacggtctggtcatttccagggtaatatgcaaggaggaggtacttcagcagaaacggaagctacgtgggatggcttggggttaggcaggtaatgtacgtatctagccggttgggtgtaaaagaaaagggagtgggaaaactggtgcatgctctgctcaaacacatagcaaatgattctatgtatttcttcaaagttctgtcttggccaagtattataaaagaatcttggggaaaacttagcctaaagaaataaagtttgggtccctgttctaccacgatacagtgaaaatgaacaagaggtgttcacaccttctgccttgcttgaactagcccggttccgtcacaccttcacctgctagagagtgtccccgtcgacggctttccctgccatcgacagaaatgcatcaggcttgatcagaaacgcaaggttttatctcagcttgaagcacctggaatagtttcttgagccacggatgaactcagtaaatatctgttgaatgaacagactaatctccttttaccttatctttgatggtagaagaggtattaaagatctcaaatgcctgcatgagactgcgttgcctgtgatactgatataatagaatgctggtatatctgtgtagcccagtgcctctcagtgttgtgaaaatccacatcgagatctagaaactcttgaaattccacttccggtgcacagaagatacagcacatgaggtcatgtttcctgtgatgcagaatgtgtcaaattcacaaggaacagaatgaacacaccacggcccttgctgcgataaatgaatttgcactccgggtgtctgaaactattgcttattttgtcacaaatagctctacaggctttgaaagctacaaaggacaactttgcaaatacttaattctaaatgtcatgagaaaatagagctacataaaggatgtttatagagggcaaggtagatcatattagtgctaatcactaaaaagtgtcccagcagtttaaaatttctatctgaagatatgaactggcacaaacattatttgcaatgaaaagtaacttcttcccctcacctagtttatagcaaattgctaattataaggataaaattgccattagaaataaatgcacaagtaatgcaatagttttctttaaaaaaaaaagttatttaaacactgtgggtatttctttcagatgaaaatggaccttaaacacaaagcttaactgttaacaaagttctagcaagggtctcttagatgcttcaggaatgtagcaccttttttttttttttttttgagacggagtctcgctctgtcatccaggctggcagtggcacaatctcggctcactgcaacctccacctcccaggttcaagtgattctcctaactcagcctcctgagtagctgggattacaggtgcacaccaccatgcctggctaatttttgtatttttagtagagacgggggtttgccatgtttgtcaggctggtcttgaactcctgacctcgtgatccacctgcttcggcctcccaaagtgctgggattacaggcatgagccacctcacccggccgctccatctttcttaatatccaccaacaggccaggcatggtggctcacacctgtaatcccagcaatttgggaggctgaggccggtggatcacctgaggtcaggagttcgagacaagactggccaacatggcgaaaccccgtctctactaaaaatataaacttagtgggcatggtggcatatgcctttaatcccagctactcaggaggctgaggcaggagaatcgcttgaacccaggaggcggaagttgcagtgagccaagattgagccattgcaccccagcctgggtgacaagagcgaaattccaaactctgtctcaaaacaaaaacaaacaaacaaacaaacaaaaaacacccaccaacagaaaatgaagtgcttaagatccagacagttacaacacgcaaggttgaccctaacggatacaaaattggtccaggatttgcaatattgccctgctcttcccagcgggggttgctgcgcacctgcggtgacagttaaatgaaaaggtaaggcataagaatttcatgcacaagcacctgtgacatctctaggaagctctgctgacgcagctgctcacatctgaagcccacaggttcaccacgggagaaatgaaggtcactggctgacattaaaactgaatggttcacatttcaaagtaccagtggggataaaatatttcttctatgctttcgtaagtaactgaccccagataatatggcagcataatctatatcctgtgacttggacttcaaaattggacatttccccttatttctaacacctccttaaaaatctccattgatttctgactaattcattgttttatctgagttaaataattaactcaattagtctattaaattcagaagggatttttaaaaggagattgtttcatgtgaaaatagtttgctttctgtttgttgcactgcatgaaacagattttcctttaagtcagcatttatttaaacctctttgatgcaaagtcttgtgctggccacggtagggaggaccagtcacactggcatgtcagtcaatttgggtcttgccctgcaagcagcctgcaattttgcagagcagcagacttggaggcagctctgtatttttctactcttactggtttttaaagacagacacacaggacaacagcgagttcaactttttcttttctctgaatctcactttactgctacattctccttttcacatgcaaatccaccttccggcctcaccagatagccttgcttttcgctgtacagagaaagccaggaccatgcaggttggagggtaaggtgtaatgaaagaatagcaatgcaagccatgtagactttggtttgtagattggtttaaccacttccttgtggtgtgatcagatgtaatttttttaatgtgatagattcaatttcttcatttataagatggaagccctaattattttaaatcaatgtagctaaaaaattacaggtcattaagcactgcatctgaatctcaaagggagcatggtgatcacctgttattgaaggctttatgcaaagattctttctggaagggtttatagcagctctccctcaagactggattagatgagggtgtgtcacacttttcagaaaagaatcactcctggcataaggagatagaatttactcctatggggcctggggcacagtgtgaagtagcctgcttcaagctagaagatatatctttgaagttttctctttcatcttaaaaagttgtaagattttccattcgactctagaacatacccttgtttattataatataaacatatttgggtctactgggagaaatatatagctctgtgtgcacaaacactggtgctacaacacataaaaatcttccaacaatttccatgacagaaagaaaaccacttactgtgaaaggctatgttaaagattccagtttaactttttgtacgtatacctgagtttctcaccatgctcctcagagtctgatgactggataaactatcagatcccatctgatccctaaattttaagaaaatcttaagttgatggaaagtagctattggtaatgtcaaaaatcagactgacaaagaacttacacagtaattctaagtcacaacagaatgccagctatagccagaattaatatgtgaattgacaaaagaagcttaagacataacaaatgcattcaaagggaattgtaactaagatctccattccctatctctctttgttcaatgaatgaatgaaagcataccaaaatccagtcaaattatctttaagtcattctcccccaggaacacctggagaaagtacaaatggactttgagataaatctttgctaatccccaggcccaagtaaatcttttaagtctgcaatccattgtggcattgcttcaataagccgaatgaattttattttaggacaaatttgaaggcaattatgaaaccatttatatcaaacaacaatgacatcaaaaacataagtctttattggaagggttgagggaaataacatggtagaacagatttttaaatttaatgcccaacagggacctgggttttcaaacatgtgtctcgaaggttaatttccgactaagcaaatcgggctatttttcggtctgcttcagctttggaaactaaggaataatgattaaaggtgagataacatacagagattcactagctgccttctatcgatgaaaagagtcaaactctgtaaaatatttaaagagatttattttgagccaaatatgagtgacaatggtccatgacacagccctcaggaggtcctgagaacatacccaaggtggctggggcacagcttggttttatacatgttaaggaggcatgagacatcaatcaaacacatttaagaaatacattagtttggtcgagaaaggtgggacaactcaaagctgggggcttccagcctataggtaaatttaaacacttccctggttgacatttggttgagtttgtctaaagacctgggagggatagaaagggaatgttcaggttaagacaaaagactgtggagaccaaggttcttctgaggtcttataatggctacccttagagacaatagaggacaaatgtctcctattcagatctttaaaaagtgctagatttttagttaatctctttaggattgggagggcctggaagaaaaatatctagctatgttatctagatagaaaaatatctagctagctataaacagatgcaaattttcccccacaaaggacagctttgtagggccatttcaagatacagcaaagaaacatgttttgggctaaaatattttgtttttcttccttgtctcataatgttatcccgaagtcagtttggaaagtagtcacaataaatagggttaaataaaacctatctgatgagaatatacgaattgtagggcatgactccccagactccttagatagaaatttgggtatgataaaaaaaatcagagtttagtcctcaatatcttgataaggatttttctattttgtatgttttcaatttttaccctttaaaaaatttagaaaactggcactgtaaagggagattgaaggagcagaaatatcaatttcgtttgggagacactgacagagggtgagccccaagacacacatgctggctagggaaagaattccggtatccctttggcttacctgtgccatttttatatgacttaggcacccaaaaaagtcctgaaccttctgttgtaacttctattggaaagactaaacaaggcagctattttgccttcaagtgctagacttactgtgcttaatccagttcttgctttttgttcagcttgttatgcttatattcataaacctcaaactatcaactgacaaccctgaagggtgaagagcaagtcactactgttggtaaggagaggagaacacaaggcttgatggccagaagggaacctgcagcttcacaaaaaacctcaggacattctggttcccagatagttcactttttcccttaagaaagagtaaaatattttgtttgtttgtttgtttgttttgagacggagtctcgctttgttgcccaggctagagtgcagtggcacgatcttggctcaccacaacctctgcctcctggattcaagcgattctcctgcctcagcctcccaagtaggtgggactacaggtgcacaccaccactcccagctaatttttgtatttttagtagagatggggtttcactatgttggccaggctggtctcgaactcctgacctcgtgatctgcccacctcagcctcccaaggtgctgggattacaggcgtgagccactgcgcccggcctaagaaagagtaaaatattttatgtcaaatgtaaactcaaaggacacaaatcatgtacctgaattaaactgtaaacctaaaatctggccatgagtcacacatgtctcttatacatcggcctacatgttacaacatatatgtgatttggtaggcgcatcattgcagacttcatctttgatttctgcatttgtcaacagacagaactaaatacaagtatttttgcaactgtctcaatcaatttataagctatgaagaagtcttattcctccctcctgcagtccttagaaccagtcagagccttggagatgacctacttaaaatcctggattttacacggaaaccaaaggccaaagaaattgtggtattctcttaaggtcaaaaagttagctttgtggcattagagcacttgaattattattaaaaaggtaaatgaaagagttatcagtctcttactatatagaagtatatttgtaaagcacaaaaacataaaattcttactttcattagtactgacaaccgaaatgagtgactgaggcagaaggctccgtcatcaaggtctattattccagcttgagagcatgcctgggaaaaacccaagtcacagctacctttgtggctgctttttccctaagaggttctcaggagatttagcatttatgcattttccttaaaagggggaggcaatgagacatacttgtgatgattatatacttgtgagcctttagatagtgcccagtaaacctacattttacataagataaggtgaacatttaaagaaaatcagaatagaggaaacagctgtctcagggagggtgaaggactgatttatcttatcttgcctttattctgtacctgggaagatataagccagtgatggacattatcagtgtggggccttttttttcttttgagacacagtttcactctgtcacccaggctggagtgcagtggtgtgatcacgcctcagtgcaacttccgcctcccgggttcaagcgattatcctgcctcagcctcccgagtagctgggattacaggcgcgcgccaccatgcctggctaattttttttttttttttttttttgtattattagtagagatgggatttccccatgttggccatggctgctctcaaactcctggcctcaagtgatctgcacacctcagcctcccaaagtgctgggattacaggcgtgactcaccatgcccagcctcagtgtagagtcttttcgaaggcctggtttctgtttagcccttagggaaggaagcctagaggtggttagtgagggtggggacatgacaggcctgtctgacctcccaccccatcatggctggaactcagcttccaaggtgtctccacggtccccttgacaaggagggattctgttcagtcagttggaggcttacaattttatttttatttctcagtataaggagtacgcagaaactatatttacagataaattaatactatcctccgattttcatctattatgtggttaattatgtctaatttgattaatgatgtatgattaatacatatatatacacataagtaaaacaattataagaataaaaaatagatttaaaacacccttttatttttaagtctgtaattatgaatttgatttatctccaggaaaatataatattttaaaataaagaccaaagcaacatatttaaacataaattcaaaagacagtaaactgtatatttataaaggacaccgtgatattatgaatagtgaatgagaaagcaattgctgaaaccagatctgttttgtagactttttgtatagctttcatatggagaaagtttcacattgttctctcacaataaaaatgcaaataagccagtgagaaattcttgtattcataaataacaaaataataaaaaatctcctttatcaaataggcaaagacaaaaattatgctgaaagagaggcaggagggagccctctcaaacatgggaagccagatcagaactagagcagtgtttctggaaaggaaggtgacaatatggatcaagaacctcaaaaatgtccattaccgtggacctgcaatcactgttatgaccgtattcttagagccaaggcatgcagtcaatgatgtctgtaaaataatatggttttcagtcttatttgttttttttttttttttttaactgtgagtaaatgctcaaaagtggggaaatggttaaatagaactgagacagccaaggtacccaagggggtacccggagaaagtgaccagcctgtgcactgggagaaagggatggagccttgggaagttcatgctgtttggggtggggaggagcctggcctctcctgatctgggtagtacctgggatttcagctggtgaggtgggaaaacctgcctggtttctgtttagcccttaggaaaggaaacctagaggtggttagtgagggcgttggcataacaggcctgtctgacctctcaccccatcatggctggaactcagcttccaaggtgtctccacggtccccctgaccaggagggagtctgttcagtcagttggaggcttaatattttacttttattttccagtatgataaggagttcacagaaactatatttacagataaattaatactatactctgattttcatctattattttaatccatattcattttgccttatagattttcatctatattcatcttgctttgctgagagtccctgttaccctttttcttttcctttttgcccaataaattccatttttctcacccttcaaagagtctgcgggcctaatttttcatggttgtgtgacaaggactctgtttttagctgaactaaggagaaagtcctacaacagcatatccccacataacggaattttaggtacctatttttaaaaaactgttttcatggcagagaaaatttattatgattttcattttttatttttttgagacagggtctcactttgtcacccaggctggagtgcagtggcacaaacagctcaatgcagccttgacctcccaggctcaagccgttctcctgcctcagcctcccaggtagctgggactacaggtgcatgccatcatgcctggctaatttttatattttttgtagggacagggtcttgccatgttgcccaggctggtcttgaactcctgagctcaagcaatctgcctgcctggcctcccaaagttctgggattacaggcatgagctgccacgtgcatgcctggcacagagaaaatttatcataatgtcctgctaaatggaaaaagcatgatacgaaactatatatatatatatatatatacatacacacacaatataattatacagcacacacacactgcaaataggcataatcaagatattgcaaaaaaattaaccagaaattttactaagcatgagggtaaaaataacttctaacactttttttttttcttgagacggagtttcactattgtcaccctggctggagcgcagtggtacaatcttggctcactgcaacctccacctcccggattcgagtgattcttttgcctcagcctcccgagtagctgggactacaggcatgtgccactacgcctggctaatttttctatttttagtagaaacagggtttcaccatgttggccaggctggtctcgaacttctgacctcaggtgatccacctgcctcggcctcccaaagtggtgggattacaggcgtgagccaccgtgtctggccacttctaatgctttttatagtttattgtgaattatttctaaatttaaaaagaaagcattatcaggaaaaaccccacaatgatcaccaaactgcacggagtgtccgtgcaggcgctcataatgtccttacacgtggatccctcgaagtcagaagaaagagttcttctctctttcttacatatggggcacttggctgccttacacgagaagggaccttattcaatcaagtggttggttatatacacacacccttaagatgcatctggatatagtcgcttctatttataaattctcccaaaggcaatcatatgaacaaaattaatgtgacaatattatttttccagcaattatcaccctgtgtatctgggaagtaagtggctcattctcttcgaaagatgttgccagttattaatacgaaagtgacagcataacagcaggaaacggggagggcaacgctcttagtaagataataccatcatcaccacatattttaatgtcatgtttaccaaccttaatggaaagtttaaaatactggctgatgagctgttttctgacttacagaagagtattttgaatttttcctttgaaaaactgaacagtgacttaaattacctgctgctatcagcgcagtcaagccctcgcttttagcacttttcaatccctttcccgaaacaccagaatccccatcttagctgttcttcttgcatgttgaaagcgttagccatacacagtcattcaccttgccaagagaggctgaagcgctatattttaaaggcaatgttgtggtgcttcctgccacagcagtgactaaacatgcagcaaagagaaaatcacgtctcatttttattccttcttggaaacaggtttgttcaacagatgctgttaaggtttttgggcttctattaatcaacattttaattttaatttattagagaatagaaatagcctgataggagtgtgaatatttgcttatcacgaaatcacagagtttaaagcaactttaaaagaccatctaatacagttccaaaagccagagagagacaacacttaaaatgattagggtatatgactatttttgcttaaaagtctgaaacaatagattctttgactttattcattaattcattttggcatttcattaaaaagttctttctgggctgggtgcggcagctcacgcctgtaatcccagcacttggtggggctaaggcgggcggatcacctgaggtcaggagttcgagaccagcctgaccaatatgaagaaacccccgtctctactaaaaatacaaaataagcctggtgtggtggcgcatgcctgtaatcccagctactcgggaggctgaggcaggagaatcccttgaacctgggaggcggaggttgcagtgagccgagatcccgccattgcactccagcctgagcaacaagagcgaaactccttctcaaaaaaaaaaaaaaaaaagagttcttcctgatatgagggctaagttctcactattgcaatttgagcttcttagccaacttcaaagaacatgtaacgaagctaatttcttttctctgtccattcggaaagtgtagagtaaggaattgtactctgaattgcctactctgcagagcaaacagactcagtttcttccactttgtccttggctcctacaccgcaattcgtattgagtcgttttccctttttttactaacaggccatctccacatttgcttgcttttcttgtgttcactgggattagaaataacaaggtcccaaactagctacttgctttcattttgagtgcatgaatgtgtgcgaagcctcagcataaatataggcaaatatggagaactgaaatgtatggaaaagacattttaaaaataaaatgtatgggctacatgttgtggtgttcataaattttttttccattcctggccgggtgcagtggctcacgcctgtaatcccagcactttgggaggctgaggtgggcagatcacctgaggtcaggagttcaagaccagcctggccaacatggggaaaccctgtctctactacaaatacaaaaaattagctgggtgtggtggcacatgcctaatgttaacattttaaatgttagcaccatattttaattttattttggaacttaatggatgagtttacattttatactcaaatatgtgagcttatattttaatatcaactaagattacatacactattttagatatgccatctcccatcttaggaccctatttacctacttaaactaagtcactggcattttaaattgtttcctcacattaaaatatacccaaattgggcagacgcatcaaaataaagcagacactccccaggaaagagagttcactgaggaaggctcgtgtggcagaacaatattgggaaagtaaggaggggggagtgatgctatttttagatccttacctcacgtccgtggagggaagtgacactatttttagatccttacctgacgtctgtgcacgtaatgcaagtgatgttccgactatttgttgcgatcaggtgcaaagctactgatgtttccttgtcagaggtggggtgtgctccacatttaaagaaaaattcctgaaagaaagataaatatgatcacacacatggatcccggctgctcatttttcctctaaatgtttccacagtaaacaatctctttggacaagagaagaaatctgttacgaggtgtgagatggaaataaatcagcatcaaacctttcccaggaacggatgaccttgtgccaaagtggtcaacaattctgttttagaagggccctgagtctctgctattcttttgctctttaagcgagggagctggagaaatacgctgtgaccttctttaagccatgcccctcgatgataataagtgagtctagaagaatcacacgatgtggaggtgggaggaagcctctcactaatgaggaaagggagacgtgaagccatgaaatgaggtgcccacgggtcaaacagtaagaggtgaagccaagaagtaacccaagctccccgcagggaaatccagtgctttttctccagtatcactacatggttagtcatttagcggagtcaggaattgagagagccctactgtaaatagccacacaagtacacatggactcctggtagacacagaagtgcagcagaggcccggcgcgttggctcgcgcctgtaatcccagcactttgggaggttgaggcgggcggatcacctggggtcaggagttcgagaccagcctggccaatgtggcgaaaccccatctctactaaaaatacaaaaattagccgggcatgacggcacatgactgtaatcctagctactcgagaggctgaggcaggaaatcgcttgagcccggctgaggcaggagaatcacttgaggttgcaatgagctgagatcaccccactaaattccagccgagagtttagcagagcatggctctcccagccccatctggagtctgccccttttctgcctggcatcaacaccccagcattcctgcgaagactctgccgcccaccctctgtgccaggcaactggaatgctccaatccagtatcttgctgcttcttagttcctttccccagccaggtcctgccacatactccctcattttagcttttcacataggtcacgttcttttgattgataatattctcccttctcaaccacgttttttcttcacttttttctgttctaacttctgtatttgttctcactctccttctgttcactcacacaccaaggcgtttggccagcaattgctttacttcttgtcccacagtctgcatgccttccatgatactaacatctgtgaagctaaattttttgctactgaaaaaaaaaatacatatattttactggatgacagaataacccctgcataccacacatactcctaattccacttgcgtttaactacctgaaatgtgggaaggattttcccttaaaacacttgatctggtattgacaaactttgatgtaaagtgccagatattacgcattaagtgcttttggttttgtagggtatatggtctttgtcacacttctcaacttggccttgtagctaaaaacagccataagcagtatgcaaatgaatgggtgtggctgtgtcctaacaaaaccttatttacaaaatatgtggcaagttggatttttccctgcaggccatgatgagacatttgtagaatgctttattcatatttgtattctaacagtgactgacattaggataggcatgacatatacttcttttttttttttttttttttttgagacggagtctctgccttccaggctggagtgcagtggcgcgatctcagctcactgcaaactctgcctcctgggctcacgccattctcctgcctcagcctcccgagtagctgggactacaggtgcccgccaccacgcctggccaatttttcgtattagtagagacggggtttcaccattttagtcaggatggtcctgatctcctgacctcgtgatctgcctgccttggcctcccaaagtgctgggattacaggtgtgagcctgtaatatgcccagcctgacatatacttcttaagtgaaaaacaatagattaatcaacgctatttaatcaatgttatttatcatttatttaataaatgctatatgttatccccttatacgtttgacagcaacatttgatttcttcttttcctgtttataatttactaacctcatcctcctctgacatgtgacaccatgagcaacagcccttggtctgaagctgtagtgtgcatcagaatcactcgggtgggagggggcacggacttgctaaaccagagatcgctgaacccaccctgggatttttgtgatttctgggatggcatcaagattcgcatttctaacaacttgccaggtgatgttgttcctaccgctcaggggcccacacttgggaaacctgagctccaccaatgtcagaggcaaagtgagtaaactctagttactctctcgcaagaccgctgctgtggcaggtcgcttaccgtgtctgaaaataatgctacatcttacgtaaaatatgtgactctcaaaaatctggagtgtgccattttactttttttttgagacagagtctcactctatcgcctaggctggaatgcattagtgcagtcttggctcactgcaacctccgcctcccaggttcaagtgattctccctccttggcttcccgagtagctgggattacaggcacccgccatcatgccaggctaatttttgtatttttgtagagatggggtttcaccgtgttggccaggctagtcttgaactcctgacctcaagtgatccacctgcctcggcctcccaaagtgctgggattacaggtgtgagccactgtgcctggctgagtgtgccattttgatgagagtatcccaaagccagggatttggaacccaggctattcttcactacaagtctcaccaatcccaggtggtataatttagttaactaaacctatcctatctggggcagtggaatatcagccggtcctcacacctgcagtcctcagcccatggaggcatgtgtgtggagtcttgctggagtggacaggatgtccagtgtgtgtgatgggcccaggctcaggcatgcctgtggagtcctgcccatgagtccaggaccttccccacagcagcatggaaatcatgctggctgatgtttttgtttggttatgttttgttttcctgaacataggatcccattccttttactcaatcttttgaaatgtgacaaatccttcaatggccagctcaagggtattgagaaagagatttaaaacaatgtctgaacaccaaaacgaaaagtctgaaggacatgactgacccttatgaaatacgctgagctagctacgactggtttttgcagacatgaaaaaaatcctctttcaaaacataaagtaattcctccaaaacagctgagttggcaggactattgaaaaagtatttcatatacagataaatagatagaaagcacttacgttttttcttagcttacagaaagctgcagtggacattcagctaacaaatcacaaattgttctaacaccagataaaattcagccagataaaagcctttttattgggggtaggtgtttatagataatggtttaagaaattacagatagttgaaaaattctagtaacacatatagtgttgataaaactaaaactcacattgccaaccctatattaaatatgtatgcctcaacagtaaatttcagtgctttctccaccaatttttatgaaagaatgtttttgttgtagtactagaataactggcaagaactgtgaagaatgtgggattttacccagcttgcaagttagcaagttagtttgctgcagtatcataaaagctgacagaagacaagagactcctggatcagagacaaaggactgcagaactcagagcacagggagaaagaagcatgagcatcatattacaccagttcccctccacacgtctctctcagggttgaagtagataggctaagtcagattctacaggtgcagtggttttgcatcacaaatgagaactctgaacttaggaaactcaaatcttctttaagtagttctaagcaagtcatcttttcatcctgaagggaaacattgtctttattatactgcataataagcaaatctgccttttgatctggagagaaacattatcttctctactttctgtttttttggtttttttttttttttttttttttaagacagagtcttttctgtcgcccaggctggagcgcagtggcacgatcttggctcattgcaagctccacctcccgggttcacgccattctcctgcctcagcctcccaagtagctgggaccacaaggcgcccgccaccacgcccggctacttttttgtatttttagtagagacggggtttcaccatgttagccaggatggtctcaatctcctgacctcgtgatctgcccaccttggcctcccaaagtgttgggattgtacaggtgtgagccaccacgcccggccctatcttctctactttcaaggtcatttgctctaaaacttccttgaaaagatgggtcagaacaagttggtgtctccctcagagatgagcggacaaatgacagacccatggagaattgcttctcaataataacaccttttcttgcaggctaatttgcagttattttattgtattttattttattgtattttattttattttattttattttatttttttgagatgggagttttgctctttttgcccaagttgtagtgcaatggtgcgatcttggctcactgcaacctctgcctcccaggttcaagtaattctcctgcctcagcctcccgaatagctgggattacaggcatgtgccaccatgcccaaccaattttttatatttttagtagagatggggtttcaccatgttaatcagctgatgtcaaactccagacctcaggtgatccaccggcctcggcctcccaaagtgctgggattacaggtgtgagccactgtgcccggccgatctggtcatttctgctcctgtacaatcagtgggctggattgttgaagtcttttctgacacttccaatctgtattcaaaaccagcagacaataaaggaacacacaatagaagtgagaagggcctttttcgaaaattccaccttgggtgtctgagatggcttgttcacacatgggtgtcatctcacagacagtggcatgattctttgggattaactgcctctgaattctgttttgtttctcttaattactcagtttaaaaaattaaaaaagtcaaagacaggaaagctttctagctggagtccaagaaggctggtcagaaggctggcaccactgcaccactgtgaggtcactggggcatagcagggcccaagccaagtggccaagaaacatctccagctgtgctgagcgacagtggttatgcctgaggcaaggctgctcaaggtggcattgtttgagttctagcgtgtgcaggggttggccggggaagttgcttctcggtcactagggaagcagagtattctgggggagcagccgggcagtgtcctcttcatcaggaagcccagctgtcaattctagtgtggctggaacagaatcctttacggcgggtaaactgagtctcagagcggcccaccccacctcttacaaatggtagttcacagataaatcagctacagaaagattcccccacctaaccaggagctataattcccaggggcttactcacatcatttgtataccaatagtcacttctgggaaaccttaattagcgaagagagctaaaatctataacagcaaatggccagttttttgtttttgtttttccaaatgatagcctaaatgattttatacttgaaaaaaataaggctttagaaaatgtgcttggctttatattgtgacactgttaaatgccataagcgttttcaactttatttatttttttgagacacggtctccccctgtaacccaggctggaatgcagtggcacgatcttggcttactgcaacctacgcctcccagtttcaagcaaatctcatgtctcagcctcctgaatagctgggatcataggtgtgtgccaccatgcctggctaattttttgtatttttagtagagatgaagttttaccatgttggccaggctggtctcgagttcctgacctcaagtgatccacccacctcagcctttcaaagtgctgggaaaacaggcaagagccactgcgcccggaccgttttccacttcattagtattaaatggaaaacccaacaaagttgtattcctcaagttcttagaaaggctactcatgcttttaccatttctctggacaaggctgtgatcccttccttccattcttctctttcatcataactcacttgccctctcctcctcactgtcgaagcctgaccctccaaatcacatcagacccatacaaatcaaagggggaccaggggagaagagcaggaagatgtcaactggactgtggtattcctggaagccactcctgctcacttatgtcccttcacccatgactcataagcagtgccactcacaaagaggaaaactagagcaagaagaatggaataaatagcccagcaaaatctgaaaattagattgacaccaagaatccaactgtataaacacatttacgatcagaagcgaattagccaaacccaaatacaatttgatagatttcaaattactataaaggtagatgacaactggcttgaaagccctgcttatcacagtcctaatatggtcaaatctgaaaaaatcattagcagtaagacctgacttagttacccatgatccttccaatagcttttattgaacatcctaaattttatgtttatagatattgtttaacaattatgttttccaaacgaaatattgtatctatcttcacaaagagttaaattccattcttgtctccaaatccttcttagttaatatttcccaaaagaaaaaaaaactatccttctcttgataaagtaatggggacacacactttccactaacaaggttgcaaagggtatagggtttgtacttaacacgtaactgcatagctatttgcatggctcagggtatagttaggaaaacagggcccacaccaggtagttcaactgacggaattgaatgagattagttatagaggagtggaagcacagaagaactaaacagagaaaggaagccacttgagattagcgtcattattgcacagctgccatctggggctagaggacaatgggagaaggtattggagtcaccacagctctgcagctgggctatctggttgggagtctgacaatgaatgggatgaagccactgccagagatgtcccctagagagagagggagaaatgcccctggcttctgccttctcttggccctcccatctccagaaacagccccaacttacagagcagagagggggaaaaggtggcttgggtctgaaagccaccagcagatgactgctgcaccaccacgaggtggaccctgtgtgagatcaaaattctccaagtgtcaccctttgttagtggtgacacattctaatcagcctccactaaaaacaaaaatacacattcagatattgttgtgaaatatgtattgaagatacagaaatactcacacaaatatacattgtatattgagattaaactcaactatactcgtcaaaagactatccatccaaattttccgatgatattaacaggatacagggctgtggttactgcttatgagatgaactcgtaataagtatcttacatctatatcagaaagattctcacagttaccaagttaagacagacagcctgtcacttcaaatcaatctaaatgcctctcacaaacctaaaatcctgtttgtagctaacagcaacagatattccccagttactctctcctcagaaactgtccaggctagaatagttcctcgttagtgagatacagattcttttctaagacacaactactagttttaagtcttcctatccatgcagaggtttcattattaatcttaataataaagttttaattttctttaagttaaaacatgtcagctgggtagggtggaacacacccattgtcccagctatttgggaggctgaggcaggaggatcgcttgagcccaggaatttgagaccagcaagggcaacatagcaagaccctgtctttaaaaacaaacagaaactccacaaaaacaaaccaaaaaatgccagataaagcataaccacaacattctctacctaatacataaaaaaagcctttaaaatagccatggcaaagcctgtttatcttgtgacttctttattgtgtcttagccttcatactgaagtgttcgacttactgggtattacataaacccagtaactgaatttatcagttctgatacaaagtaactatgcaaactggaggactatataataaatgtacactttgttaaattaacaatgccagttttacaattaagttacacctagtcaaacagatcagacctaaaaagttaatgagtctatcaccatgttcaattacaagtttgttttctctcaagatgtcaataaagcctctagatgatgtgcaaagtttatcaggagaaagaaaatcaatatactccacacaaagcaaaaccatgtcacaactttgctgagaaggaggctgtcagtttatggtacatgtcttcaagaagtctaacttaaaacaaaagttggctaatataacaacccacatccgccccttctctgcctgattgtaagttcttcagtgtgccttgaagtttattccaggtgtaatgccactcagccataatttgatgtttataactttaagagcaaaagggagattgttaaagaagatgttaaaagtgattcctgaaaagtaaaataaaaggtttgcccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattactattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcacggcacatgtatacatatgtaactaacctgcacaatgtgcacatgtaccctaaaacttagagtataataaaaaaaaaaaaaataaaataaaaggtttgcagtcattactgacccttataaaatgcgtgaaaactaggaaaactaatattctctttcccagctcaaggtacttgctccaataagctcagatggctgtacctccttttcccctccccagcccaggggtgaacaggcagctctggcctcagcggtcagagtaaaacaggctcatacatgtgaccacaatgagatacctgtctgagaaccaagccggtgctcagaaggaaaaagtgatgagagaaagacagtctccaagaaagagatcacttgtaccctggatccagctatgcctgatgtttccccagttacttattaatttttatttatttatttattttgagatggagtctcattctgttgcccagactggagtgcagaggcgtgaccttggctcaccgcaacctccgtcccgtgggttcaagcaattctcctgcctcagcctcccgagtagctgggattacaggcgtgtgctaccatgctgggttaatttttgtatttttagtagagatggggttttgccatgttggccaggatggtctcgaactcctgacctcaggtgatccacctgcctctcaaagtgctgggactacaggtgtgagccaccctaatccctggctgtgtttttcattctttaatttagcagtgcccataggcacttccaagactgatttccatattatctgtcagactgcaaaacaaggattttcctttattatctttattatcttggagaaagctttgaccttaggcgttgtcccctagataatctatcactggggaatttttcagagcaaatgcttccactatgtttgttgctatttctttacttgtgcatatgatcttgctgttagcatttcatgaagggtccctgactccaaacgctttagaactatgggacagttgtcaaagttccacgctgcacagcctccctgagagtgagcaggaggaccctgctggccagatgaagcagccctccctgacctctgactcattcctgggcaggaatggccatctcaggggaaactggatcgggattacacacaacacagcaaccatgtttttttctttccttaggttttggactagtggctctggtgtggtaccagcttcccctgcatttctctcccaattccaacaaacgtttggagattgtaacttgtctcacctcaacataatcgcagtgacttatgcgatgtcatctgctcagtttataaatcgagcatatctcttccctttcaattttgtagcctagcccgacaataaaagaacatttattattctagctgttctttctctcctttagaagctaaaggtttcacatgctctcataatatgtcagcttcaagaacataacggcacccaaaacatttgctagttgcatgtttaggccaagctttccagcttttgtgctcagataaataagatgttaaaatatctggttgttaacatggaatatttccttttgtaatctcccaccaccgagtgttcgactccatgatttgacctccaggagaggacatataaacgaacatgtgttagctggtaattatttacgagaaactgaggagacaggtcacaattttgaaaattccttatgactcaccatccctagatgagttactatattcctaacattttctagggagtctctagaagacagtattattttacatttatttctaaatgtgcaaaacacttattctaattaacaatggcaaacaatgtagacgagctatgtaatcatttcactgtctgggttaattatcttccaggccaagcacactggccgagcaaggccttgtagactttctaacctccttgcctcactgcctcccacctcacctgcccacctctcccttggcctgccatggagaccctttgaggaggggctggacttccccccttcactctggccccttgcttgtggtttgagctcagcaggatctgtcttcttcctctgctttgtccactcattttgcctttcaaagccctagatgtctttcggcctcagtgtatctatcttcaaccctggaggccttccttgatcctgtccctgttttagctagtcctcaattatgtccggtgcctaagctctccataagatacatccaccagtgtgtcatgtcagtttaccattgccatggcaacatccaggagttaccagccctttccatggcaatgacccaatgacccagaagttactactcttttcctagaaatctctgcataaactgccccttaatctgcatgtaattacaagtaggtataaacatgactgtagaactgccctgagctgctactctctgcctgcagggtagccctgctctgcagaagcagtcacagagctgtaacaccaccggagctataacactgctgcttcaataaagtggttttcctctactgtcagcttgttcttgaattctttcctaggtgaagctaaaaaccctcttgagctaatccccaatttaggtcttccctccccaacatcactattcttgggaattaagtaattcactctgttctctccctgctctttggttagtctgcagtgtcctttttttttttttttttaagactttgatattccatcttttgagttacaattgggacaactgagagaggggaagagctggagtggggtgagaactaggagggctcaacagctggaggtgtagttcacttagtttttgtactggaagggttcatcactggtttcattgagaagtcaggtgcgacgagagcttctgtcacctacatattcctcctaacatttactgctgctgttgaatccattgtgctgtttatttggaaaatcccccccactccctggaccaagtgagagcggaacagccagacctgagaaatgcagccacagcaacttcacagtgtccagtctaggcagggaaagtgcaagagaaacataccttttgatagcaatacttcacaaaatgataatataactggtttgttggctatgagcaaaaagaaatattgagcaataaaaaaacagcctagctttaaaacattttaaatgactttagacttggaatctaaacttttttcgttcaaaagtccttgtttctttagcaagtagaatttaaagcttctttttattcgtgtcttctttattgcaggcagcacaagccatcataaacattccactcaagataaactgggcaaaggcaagtgcttaacacaatttaatactttctcacattctatatatttactttatttcctcattaggaaaagaagaaaataaaatgtaatttgtaaatttacctataaaccatataccggaaaactaagatgaataaaactggaaaataaatgttacactgagttttttcttttaacatgccagtacaagtgataaccaatggaagaattaaaaactcaaccagccatcctacttatgtaaaatatatatcgatgggcgtagacatgtgtgctttatacatatgatcatccctcagtatccaggagggactggttccagaaaccccctgcagacagcaaaatctgcagatgctcaagtccctgatataacatggtgtagtatttgcatataacctaagcacatcctcctgtgtactctaaatcatctccagatcatgtagaatacctaatacaatgtaaatgctgagtatatagttgttacactgcattactttttaaatttgtttttaaatattgtgttattttttgtttttatttttgaatattttcagccgatgattgaacccaaaaatgcagaagctgtggatatcaagggctgatgttacatagattgactgaaaaatttcggagtccaattaatactgcatctaaaataagttaaataacatcaaaccttttgtgtcataaggacaccattaaagttatttatttgtttatctctcctctattttttgagaaatgtatgctgtgttggagaggcaaagaaggaggatggcaaatagtgcagcatcatccggttgctaagaggcatatgtaaaaacaaagaaacatcccacaaggcaagaagaggaactgttagagtgaacgatgctccctcttagcccaggcttatcattatagaacaattctcaggcgatggcatctatgggcacagtttgtgtgtgagggcaaaagactcctgtacagctcatgcccccaccaggagagaaaagttggtggccccggccttccatcactgttggggaaaagtcaggaagagtcagttcttccaaaggggaaaaaaaattttttttttaatctaaagaaaattcttcagggctgggcatggtggcttatgccagcactttgggaggccgaggcaggcggatcacctgagatcaggaatttgagaccagcctggccaacgtggtgaaaacccgtctctactaaaaatacaaaaaattagctgggtgtagtggggcgcgcatgtaatcacagccactaaggaggctgaggcaggagaatcgcttgagcccaggaggcaggggttgcatgaggcgagatcccgcactgcactccagcctgagcaacacggcgagactccgtctcaaaaaaacaaaataaaataaaataaaataaataaataaaaagaaaaattttcaggaaacataactaggacacaataaagtgtttcaatcaggtttaaacataacttgagaatataagaattttaaaatttaattaaaagctaaaaaagaagagtaaaaacagagaaaacctattaataaaatggaaatcatgagtgaaagctcagagccatgaacacgacagtgaggacatcaatatataaatcataaacacagagaagcggaacccaaaaaaaaattgcagaaaagatcttctgtgggttaaagctacccaatggataataccagtactacagagcattttcattgactgcctgattattataacatgtttggtaagttacttaatcaaatttatggtagctgtctttatcatgtttaatttagctgatttttaaaaaaatatttacaatgagctttatcttttttttatactttaagttttagggtacaagcgcacaacgtgcaggttagttacatatgtatacatgtgccatgttggtgtgctgcacccattaactcatcatttaacattaggtatagcattaggagacatacaatgagctttagtacaaacagcttctaagtttgatcaagtgatttggattcactatggacataatcacacacatctcttttaagctttagatagcatgaattaaattgatggatatgtgaagattatgatatcctgacactttgaaataaacacttactcctttcttactttcatagtgcctggaaatatatatatacaccatccagggcctggggatcaaacagccttacccgttacagctggtgcccatgcacatcagggggcctgaggacaggtctgccttcctgctgctgttcccaccagtgcgtggatataccatcaactgggagcctgggggtcaacctaccatacctgttgccactggcaactgtgtatgattgcagggcctgtcaacaggtctgccctgtccttgatgcctgtgcataccatctggggcttgaggataggtcagttacaccccccaccacctctgctggcacccaagcatgctatatggggacctggggaccaatgtgtcccagccgccacagcctgcacccacacacactattggggacctgaggacaggactgccccacctgatgctaccactgacagtgcctgcatgcttcatctggagacctggggattgatctgccccacatgctgctattaatggctatgagcaccttccagggccctgacgatgggcctgctcagcctgccggtgcccacatactttgactgtgggactggggaacgaccctccctgtctgctaccaccagggctcacacacaactcccagaggactgaggatgggcccactcagccggctgccatcaccactgctggccatctacccatatgcatcacctggaggcctgagcactggcttgcttaccctgccaccaccaccactggtgcctgcatatgctgactaggaaccagagatgtggcttgccactactattgccatgaatgatgccacacaccacccaggagcccaaggaccagcctgccctcccagcccactgccaccactgccagcacataagcagactatctggaggcccaaagtttggcatacccaaaccactggtgccaccactgtgcccgaagaccagcccacttggtgtccctgtccccacaaaagcttcactgcaacctctactaacaagtgctgcccgagccactgaagagatcacagacacaactgatgctgattacagctgaagaaatcattgagacattacactgctgtgcccagctagaatcaaagccaaggtgacctaccaaagcaacattataaatacatctgtagaaaaaagtagtctttttctaaaaaagccaatccataaaattggaagaagcaactgctacatcagaggcactgtaaaaagctcaatgagatatgatagaacacaaataaaagatacgaaatatcagaaaaacaattcatgatctgaatgagaaactaaacaaagagaaagatatttttaaaaatgtctaaacaaaaatcctggatctggagaattcaatgaatgaaataaaaatacaattgagggcttcaaaaaaagatgagatcagggagaggaaaaaagaattctgaacttgaaaagagatcatttgaaataacccagttaaaaaattttaaaaaattattaaaaaataaagtaagcctatgggatatatgggacaccacaaagcaaacaaatggaatttggggtgttccagatggtgaagtgatgatcaaagacatggaaagcctatttaacaaaataatatctgaaaacttctcaagtcttgcaagagacttagacatccagatacaaaaagctccaagaatcccaaataaattcgactcaaaaatgtctttttcaaggaacattagagtcagactgttaaaagttaaagacaaacagaattctaaaaacagtaagagaaaagtgtcatgtcatatataaagctatccccatcagacaaacagcagatttcacagcagaaaccttacaggcaagagagaataggatgatatagagtgctgaatgaaaaaacatgctaggaaagaatattctaccaacaaagctatctttcaaaaagaaaggagaaattaagtctttcccagacacaaacagaaggaattcatcaccactagacaagtcttatgagaaatgctcaaggaaattctacatctggaaggaaaaggacaatatgtaccatcacgaaaacacacaaaagtgcaaaactcaatggtagagcagacacacaaaggagaaatgaaggactcaaatgctactattacagaaaaccaccaaaccacaatgataaacaacaaaagggaaagaaggaacaaagcatatgcgaaacaaccagaaacaactaataaaatgatggaaataagtctttactcattaataataacttcaaatgtaaatggattaatttcccccataaaagataataaatggctaaatgaattttaaaaaatggcccaactggccaggcgtggtggctcatgcctgtaatctcagcactttgggaggccgaggcgggcgggtcacctgaggtcacgagtttgagaccagcctgcccaacacagtgaaagtccatctctactaaacatacaaaaaattagcctggagtggtggtgggtacctgtgatcccagctactcaggaggctgaggcaggagagttgcttgaacccaggaggtggagcttgcagtgagccaagagcacaccactgcactcagcctgggtgatgagagtgaaactccgtctcaaaaaacaaaacaaaacaaagcaacaacaaaaaaatggcccaactatatgatgcctacaagaaaaacacttcacctataaaaacacataaagatgacagtgaaaggatagaaaaagtcattccatacaaataaaaaccaaaagtggacaatagtagctatacttacatcagataaaacagattacaagtcaaaaaatctaaaaagagacaaagaaggctgggcacggtagctcacgcctgtaatcccagcacttgggaggccaaggagggcagaagtcttgaggtcaagagttcgagaccaacctggccaacatggtgaaaccccatctctactaaaaatacaaaaattagttgagtggggtggtggcgcacctgtaatcccagctactaggggggctgaggcatgagaactgcttgaacctgggaagcagaggtttaagtgaactgagatcgagccacagcactccagcctgggcaaaagagtgagattctgtctttaaaaaagagagagagagacaaagaagatcatcatataatgaaacatgtatcaattcagcaaaaggatgtaacaattctaaatatatgtgtacccaatagcagagcacccagatatattttttaaaaaattatagattgaaagggagagatagaccctgatacaacagttgggggcttcaatgcccctatttcagcactggatagatctatgagatagaaaataaagaaacactggatttaaattgcacttatgaccaaatggaattaacagacttctacagaacatattattaagctgcagaatacactttcttctcatcggcacatggaacactctctagaatagatcatatattaggacataaaagaagtctcaagaaatttgttaaaatcaaaatcatatcagatattaatatcttttcagacaacaacagaataaaactagaaatgatagcaagagaaactttgggaactgtacaaatacacggaaatttaacaacatgctcctgaatgaccattaggtcaaggaagaaactaagaagaaaaccaaaaaatttcttgagagaattaaaaatggaaatgtaatatattaaaacccgtgaaatacagcaaaagtactgctaagagaaaagtttatagcaataaacacctacatcaaaaaagtagaaagacttcaaattaacaacctaacaatgtaccttaaagaactagaaaagaaaggacaaaggaaacccaaagttagtagaaggaaagaaataataaagaccagagtggaactaaatgagatagagacaagaaaaatgtaaaaaggattacaacaataacaacttggtttttgaaaaagataaaaatcacaaactactagttagaataaccaagaaaaaagatagaagactcaaataaaaaaagcatacacgaataggagacattaccactagcaccacagaaatacaaagaatcattagagactattataaacaactacatgccaacaaattggaaaatctagaggaaatatataaaccttggacacatacaacctaccaagaatgaagtaggaagaaagaaaacctaagcagacccataatgagtagtgagattaaagcagtaattaaaagtcccccaacaaggaaaggtccaggacaagacggattaactgcagaattctatcaaatttatatagaaaagctaaaagcaattcttaaactatttcaaaaaggtgaagaggaagagattcttcctaatgcattctacgtggccagcattacattgataccaaaaccagataaggatacaagaacaaaagaaaggaataggccaagatcactgtcttagtcgatttgtcttgctatattggaacacctgagactggataatttataaagaacaggggtttatttgacttacggttctgcaagctgtaaaagaagcactgagccagcacctgcttctggtgaagggctcaggctgcttccaaccacagcagaaggcaaaggagaaacagcatgtgcagagatcatgtgacatgacagaaggcaagagagcaggtgaaggtgccaggctcttttttaaacaaccagctttcatgagaactaatacagccccttacctgagacagggcattaatctattcatgaggaactgctcccatgacccaaacacctcccactaggccctacctctaacattggtgatgaaatttcaacataagatttgggtggtcaaatatccaaactatagcaacccgttatgaacatcaatgcaaaaatcctcaacaaaatagcatatcatgatcaagtgagatttttctcagggatgtaagaatggttgaacataaacagatcaataaatgtgatacatcacatcaagataatgaaggacatatagaagcatggtgtgcagaaaaaaaaaaaagaaagtgaaggacaaaacccatataatcatctgaatagatgtagaaaaagctttcgacaaaattcaacattccttcatgataaaacatcaacaaactaggcatagaaggaacatacctaatggggaaaaggtgaacgtctatcctctaaaggactgaaacatgactaggatgcccactctcactactccaattcaacatagtactgaaagtactagccaagtcaatcaggtacaagaaagaaaagtcatccaaactggaaaaaagaaagtcaagttgtccctctttgcagacaacatgatcttatatacagaaaaacctagactccaccaaaaaactcttagaactaataaatacagtaaagttggaggacacaaaatcaacatgcaaaaatcaatagtgtttctctataccaataacaaactaattgaaaaaaaaataaagaaagcaatcccatttacaatagctaccaaaaaatctacttaggaataaatttaaccaaggaggtagaagacctttgcaaggaaaactacaaaacactgatgaaagaaattgaagatgacacaaaccaatggaaagacatgccctgctcattgaccgaattaatattgttaaaatgactgctcaatgcaatccctatcaaaataacaatatcattcttcatagaaatagaaaaaaaaaaaacagtcctaaaatatgtatggaaccacaaaagaccctgagtagccaaagcaatcctgggcaaaagaacaaagctggaggcatcacactacctgatttcaaaatattctgcaaagctatagtaaccaaaacagtagggtactggtataaaaacatacacatagagcaatggaacaaaatagtgaacccagaaatcaattagtgtatttacagccaaccatcttcaacaaaggtaacaatgacaaacattggagaaaggacactacaataaaaagtgctaggcaagatgtatacaagaagaatgaaactagacccttatctctcactatatgcaaaaatcaaggcagaatgacttaaacataaaaccccaaagtatagaactactagaagaaaacaaggaaaacattcaggacattggtctaggcaaagatttttatggccatgagctcaaaagcacaggcaataaaaagtacataaatgggactatattaagcaaaaatgcttctgtgcagcaaaggaaacaatcaacagaaacaacctgtagaatgggagaaaatatctccaaactattcattcaacaagggactaatacccagaatacacaaggaactcaaaaaactcaaaagcaaaaatacaaataaacccatcaaaaagtgagcaaaaggttagaatggacacttctcaaaagaagacatacaaatggccaacaggtatatgaaaaaaaattaaatattactaatcatcaaggaaatgcaagtccaaacagcaataagatatcatcttacctcagtatggctattatcaaaaagacacaaaataacaaatgttggtgagaatgtggagaaaaggcaactcttatacactgttgtaacctgtaaattagtacagccattctggaaaacagtatgcaggcatctccaaaaactaaaagcacaaggtggcttacgcctgtaatcccagcactttgggaggctgaggtgggaagactgcttgagtccaggagtttgagacaagtctgggcaacataccaagaccccattttcacaaaaaattaaaaaatccccaaaattagagctaccatatgatccaataatcccatgactaggtatttatccaaaggaaggaaatcagcatatcaaagggatacctgtacccccatgtttattgtagcacaataggtcaagatatggagtcaacctgtgtaaatccaacagataaatggataaagaaaacgtggtgtgtacacacacacacacacacatacacacgagtactaatcagccacaaaaagggtgaaatcctatgcttgcagaaacctggatgaactagaagtcattatgttaagcaaaataagccaggcactggacaaatacctttccaaagtcaaaggtgaacattaatcccattctggttactggacctttattgaactgacccaaataaaaggttcctatatgtttcttcaagccagcagtatctacatactttactttaaaccccgcttattttctttttggctgatttgccaaaatgtggttgactgatccatcaaaaataatactgtaatctctaatggtattccaaatttactgaaattaatttgcgtctttattttccccaatttttagctcctcttaatcaaatttacatgtaactggtataagtaatttcagctaattaaatgaagaatagcagactctctatttgttataaatttaatagttacgttaacatgtattgctatttcaatacttttatatttacatagataacaacactattcagcattagttagtatatgtgaagggaacagtataagtatgaaaaacagcctacccccaaaatatatttttagatacaggagaagtttatgattaagttgtacaattttctaggggaaaaacgttttattttttttttaaattaacatggagaaagcacctaaatcatcatgcttcaaaaggaaatcacgctgaaaacaacccaaccacttacatgtgccccttgacattggactcatatcagcgggtagctagctcacaactgaaatgacccataaatcttgcaaacctagtctacctctatacacataaaagagcaagcttcaattgcgttctcgaatgacaataagtatgtacaatgaaatacgtaataaactgagatctaggtggctagcacattcgacgcaacgtgctctattccatagacaattccattctacttcttggtgcattaaatgaagttattttccttatatacatagatctgtatactcattaaatatagtgacttctgcgaaaaaatttatttctaccctgcagtggaagcctaggaaaacattaattttatgttactgagaggtacaaactacaaccttctccttagaacaggaggtataaaaatcagcctcctggggttctgttgctaattcctctggacggctgggaacttgatctaagccattccacataactggacatcatttacaacttgtgggttttgtgcagtgtctctgtgccttcctacatggggactcaatcacataagcaagaaatttcttttccccagtcacctaactcagtaccagccagctagatggcatctctcaaggcactgtggtagaggcatggtggctgttactcatattacacttttccaatcagttgggtcaatctgtctactcagaacatactaagtgatatcaggcacctgctattctgtggtgactgtgaaatactcttcctcactctacatgtacaaatctagtttcttttcagaaaaccagcagttagtgatagaaacaccattcccaaaccaaaatacatgagggtaaactcaagttggacagagttatcaatattttttagctgcaaacattcctttcatcaccaacacctggtgctcaatgaatgtatcattacttggctggttatatataagcccatctgtgcaaaaatggccaaaagccctctcgtagttggctggacctgtgtcctaaaatacaggagccaggtaatgacgagctttgatgaccttcataaccatgggaaagacagctgacagaaatggtttatatggcaataatgtggaaataaagaaccacatatactgcaaaatatattaaaaaacataaaacatatattatatggttattatatagcccttttaaatacaatagtcatcttttctttatagggatttttgggaagtatgagatttcccatctaagatttagtgaggaagcagtaactatatcacttttggatagtctatgaatatgagaataatgagttgactattttcagcccatttatcagccttaactcctcaaacacacaaagtagatacactgtcataaatctttattcgtgctatgatggttgccaagaaacgcttcatttctcagtaaatcatagttggcatgaagtcatgtgttgctaaatattttataacctcctcttatgaacctggaaacaatctattaactacacatatgaaaacccccatatatttgcatgtaaataaatatttatttgttttgtccaatttccatctttatctgacaaagataaaatgagtgtaacctcagcaggcaattcacatgtggccagggctccatccagttatcctagttacagctttctactctggtagcaggtagctactgtttcattagctacagtttgtatatcaggcttagactgccattcctaaaaaacaacaacatttatttacactttcaataagaggaagtttcagcgaattgcctgggctccaggaaagtcttgagagaataaaagatagtgtaagagaaatccaatcccgttatacatacttgcagtgtaaatttgtcatcgggtcaatttccagtatatttcctaacccccaaaatgcctcaatataaatgggatcttcagggaaatcatactgtggaaataagtaatttatggtgtcagtttgtttccaaagatgagtagtgtgaactgagtatgtgtgtttaggtaattttcctcacaatcccataatcattttctagtcttttgagaatgaaaaacattctactttattttgtcctcttaacacacaaaaacatttgatagaaagataagtagattctcagtagatttaggaaagggtgaagaaggatttctaacaaccgcaacacagaattatacacagcttgcctccaccacaagcgattctcctataaacccctcttcacacctctcagaatcattgccacagtgagctatcaagtctcagcaataacaacgaacaaaatcagtgtcaactgcttagagaagaggcagtctggataaatgtaaaattgacaacctgcttggggtggggcggaggagatgtcactgcaattgatttcaggaagtgaactcctcttgtgcccatctggacactggactttactggtgactgttgctgtaacagcatcatgaaaaagagtgactgtccctacctcggaattgctccacaattcctgaaaaataaaaacgtgtcttgtagtgaaaaggtgaaagcacaagcagtgaatccccatctatgcatgagcaaatatttcatggcacgtccatttatgcaatggcattcattttgcattttctatgtgctaagcaatgtgcgaggtccaagagtcacacgaaataaagcacaatgcccgagccaagaaggtggcaagaggtgaggagtgattgcactatggtgattgttagctgcagtggtaggcacagataggaatgatgaaatggaactacttttgttaccaagactaatgcaccaaaacatgaatgtgggaaaacaggacactttggtcagctaatttccgcaaacaagctttagaggacttttttacttgatgcatatggatgccagattttagattccacagaccaaaataataatagcaataacaataataataaatgatgaactgagttactagcaacttgaaaaatactgataattatatttcaaagaaatactaatagtaacaagatgcttatattaatggtaaaattaactatgcgtgagttctttagaacaaaattttgttttaaagacttacatttaaagacttgttatatttttccatccatctactgaaggacatcttggctgcttccaagttttggcaattatgaataaagtcgctataaatatccatgtgcagtcttttgtgtggacataaacttttaattcatttgggtaaacagcaagcagttaaattgctggatcgtatggtaagactatgtttagttttgtaaaaaactgccagactgtcttccaaagtgatgagaccatattgcgttcccatcagtaatgaataagagtttttcttgattcccatactccccagcatttggtggtgtcagtgtcctggattttggccattgtaatagatgtgtactggtatctcattgtttgtttgtttttttaaattttaatttccctaacatggtaagacgttgagcatcttcttatatgcttacttgccatgtttatatcttccttgagaagtatctgttcaggtcttttgcccatttttaatcaggttgtctgtttttgtattgttgagtttttaaagttctttgtatattttggatggtagtttttcattagagatgtctatttaaattttttctcccagtctatggcttgtttcattctcttgacagctgcttttcaaagagctgaggttttgtattgtaataaaatccagcttatcaattatttctttcatggattatgcacttggtatcgtatctaaaaagttattactatacctaaggtcatctatgttttttccagtgttactttctcggagtcttatagttctgcactttaacagtgaggactatgaaagttttaattttgtaaggagtacaagatctgtttccagatttttttgtttttgcatgtttgcatccagttgttccaataccatttgctgaaagactacactttctccattgtatattctttgcttctttgttaaagatcatttgactatgtatgggtctacttttaggctgtctattgtgttccattgatcgatttgtctattcttttactattaccacactgttttgattactgtagttttgtatagttaagccttaaaattggatagtgtcagtcctctgactttatacttctatttcaatactgcaatggctagtctgggtcttttgcctcttcatataaacttttgaatcagtttgttgatattcacaagttaacatgctggactttttattgtgattgcattgactctagataaaattgggaagaattaacattctgacaatattgagtcctcctatccatgaacacgggctatttctccatttatttagttaatttctttcatcacagttttgtaattttcctcatacagatcttggacagttttgttagtttacctaaatatttcatttttagaggagctaataatatttttagaggagctaatatgttattgcgttcttaatccgaaattccacttgtacattgctggtacagagggaagcaattgacgtttgcacattaaacctgtatcctgcaaccttgctataattactaactagtttgggggatttttttggtcaattcttttgtattctccacatatataatgatgtcatctgctaccaatgatagttttatttcttccttcccaattttatatgttttgttccattttcttttgttcttgcattagttaggccttccagtaaaatgctgaaaaggagtggtaagaaatgacattcttgcattgttcttgatcttaatggcaaagagtctagcttctcaccattgagtatgatgcccactgtaggttttttgtagatattccttatcaagtttagaaagttcccctgtatctctagtttgcaaatagcttttttttttttttttttttaaatcatgaatgggtgtttgattttgtcgaatgctttttctgcatctactgatatggtcatttgatctttcttctttagcctgctgatatgatggattatattaattgattttcaaatgttgaacacccttgtagatctgtcatagatctcagttggctgcatgttataatttttcaatacattgatttgctcatattttattgaggaattttgcatctatacgcatgcaagatcttggtctgtagttttcttttcttgcaatatctttctctgttgtttgtagtagggtaatgctggcttcatagagggaattagaaagaatttctgcagtttcatccttctgaaagagattgtatagaactggtaaaatttcttccttaaatgttttgtggaattcactagtgaacctaactggagctggtgctttctctttggaaggttattaattcctgattcaatttttaagataggtaccattcttttcagactgtctatttcttctactgtgaattttactagctgtgcctttcagggaatttcagctacattatcagattgtaaatatagatttgttcataatattcctttataagcctttcattgttcatgagatctattgtgatgttcttttatttccaatgttagtaatttgtgtttcctttcttacttaacatggatagtcttattgattttttaatcttttcaaataaccatttttttttttgcttcattcatttttctctattgatttcgtattttcaatttcattgattttttgctctaaatttaatacttctcttccacctttggatttaatttgctcttctttttctacttttctaacatagaaactgagatgatttattttaggtctttttctcttctaatatattcattcaatgctgtagatttctcaaaacactgctttcactgtatccacacattttaataagttatattttcattttcatctgatttcaaatactcttgtgatttattatttgactcatgtgttactgagaagtttgtgtttaatttccacgtcttttgggattttccatctgtctttctgtcattatagtgtaattccactgtagtcgagagcaaatattctatgatttctattcttttaaatttgtaaaggtggctgttttatggcccagaatgttctgtgtcctggtgaatgtttcatgatagcttgagaagaatatgtattctgttgttgttggtggtggaagtggtctatagaggtcaattatatccagttgatcaatggctgcaatgagaaaatcccagaatcatacagaaaaaccttcccccaaattgggaggttgttgacaaaaaaaaaaaaaaaaaaaatttggacatgtccagtttggcgagtagatgggttataaggacttatatatgaggacctcctggatggcagcaggacagctttagagctccacaccacctcttgttcttaaactacttttaagcgaattttctgaatttttgtatattgtgtttaagtgctgagactatttttcttgctaggttctcagacactttctaggatgcttaggttctcaggaacacctgctacttggctgagccccatagccttggctcactgcctggtcttcaaggtttaggtggtagacatatacccttggctaatgggtgggagactcatcatgctacaatggtgctgctgagttcaactatgtccttactgattatttacatgctgaaactgtccatttctgaaagagggtattcgttcatttttattgcagtttactatatcactgtataaatataccataacttgtttatgcattgacctgttaaagatcaattggaacacctcataatatagcctaccatggtaaatatgcctggtgtacttgtaaagaatatgtattctgctgttttgcacaatattttataaaagtcaattaggtcctgttgattggtaatacagtttaaatcttccatatccttaatgattttctacctatgtgttctattattgaaagagatgtattggaatctgaaacttgaattatggatttgtctttttatcttgcaacttcaacgtattctcactgcagcaacttgtttctaggcctgaaacacttaaagccttggtctcgtcacacagataaattaggagttgatctgaaaaagctgggatttggtttggatctgtatccccacccaaatctcatattgaattgtaatccccagtgttggaggtggggcctggtgggaggtcaccggatcatgtggttgaatttatcatgaatgacttagcactatcccacttggtactgtcctagtgaatagaaagtgagtgagttctcacaagctctggttgtttaaaagtttgtagcaccagctgcttcacccgctcttgctcctgctcctgctgtgtgagacacctcactttccctttgtcttctgccatgattagaacttcttgaggccttccccaaagcagaagtcactatgcttcctgtacagcctgcagaaccatgagccaattaaacctcttttcttataaatccaattaactctcttttctatatttctttatagcagagcaagaatgcactaatacaggccaccatagacctctgaccagcagttcatatttggtgcttactgcttaattatttgcttgaagataatgagcatttattgttgcagtagcaattagcaaactcctcaacaccagcgtaggtaatataaacataatgatagcactgaaagttttctgaagatgtctgttgcaaaattgtagcttcagaaagaaactaatgaactcatagaactgggagcacttggaatccacatggaaactcatttaccacactgcagatggtatgtctcccctgtgatgagcaacagcttttgcaaactggctgttgatcaggttcacttcctaagtggctcctcaggctcacatatgattacgaatggaaagaaaatttcaaggaaatagtgttgatgttgggctcagtgggataaattgtatttaagaaaaatgttgaagataatgctctatttgaattggcattattttgcaaaatactaaacatatacatttttctttccataggaaaatattaattaattgtctgtagggacacaaaggaagacttgcctgtaaaggcacttaaattaaaatgaaatgaatctcagagtaatagcttttgaaatctgaagatatgcctgaaaaagaaagctaatataaaaatcgagctaacgtttaatattaaataagttagtacaattaagtaagaaaaagggaaatgacaacatatttcaagcatgtgcttcttccaggataaagtctcaaactttggggacttttagtttggtgtgcatttgactctttattggtaataaaagaaataaagtataggacaatatagaataccaggaaagttgttcacattgggaattttgtaagaaatatgtccaaaaataaaaacaaagactgttgactcataatatatgctacatggtaagacattttatcatatcactaaaaattaagtcgacctcttcactttgattaagcaggagaaatgctgtagtggaaaagattcaactcaactctcaatccacctctgactcttgcacatgcttgctctctctctctgtctctgcaggactattaaattggtagaaaaaaaaaaaggaatgaaactcttgagcccttatttgtgttcttgcttgagtgttgacagcccgaatctattgccctgccgagaatgcctcgggctagagagaaaaaagccttcattcatgataaaagctccttaggctcagtttacttttccaagttagctttaaagtagttgagatacagaactgcagggtctttgctaatatatcaaatctaaccttttttggggggaaaaaagttaactttagaaaaccggtgctagatgtcagggttggaagatgggaaggagaaaggttgtgtattatttctattatctaaatctatttaatcctataatctgagtccaacacttgtagaattttatagccatttgtgaatttaatataaaaggatagtgtatatatatatatatctactcacattttatgatgatggtgacattgctaaatttaaaaaagcatactaaaaattgctatcttatttgaacaatattaagtaaatctgcatttcttagaattactataaagtacacgagagctttgaaacatttaaaatgaagttatatatgtgtgtgattttattttgtctaatgacttgtttgttccatctttgtttcccatcactcagcactgttcctagcacccagcagttgcttggcgtttgttgattaaacgactgacaattcctgggactttaaaagagttccaattcaatttccattcaatttaaacactgaatggaaaaattctcacaccactaattgatgcttttgccccatattcttcccacagcaaaatgagtctttcaacaatgtcaaccagattccacattcaacattgtgcactcaatttaacattccacattgtaaaccagattccacattcaacactgtaaaccagatcatattcttcccctactgactatcctctagtgttccattccacttggaaaacacaatccagatttcttgccatggtctacaagaccaacgtgagttggcccagtctgcactccactcctgtctgccctcttcaaagcactgtcctcctttcagctcttcagataggccaagctctttctctgcttacgatgccttgcactagctgtctcattagccgagagagctctgccccctggtcctttgcacatctggctcaatcttgccatttggggctgagttcagcatcctaaagcagcctcccacccttctcttattgtttgcatgatgacatcccatactgatctccatcatggcacttattggtacctagtattaactaagaaatttatttctcttgacatactgcgcccaatgaaccccagaatataagctccataagtccagtggccccctcctttttacaactgtactctagaacttagaagagcgccagcacattgtatggcttcattatctatatatacagttaaaaaattatatatacaagtaaacaaatgaaccatgaataactgaatggataaatgaatgggaaatatactatcagccaatatccaaaaattatacatatttagaagaacgatggaaaatgagcatttaaaaaaacagttttaattttgcctgaaaaagcaaggttgctattagtcatttttcaatatttaatgaagggctgtgcatttaaagaaatgtcactgctctcaggatacagtgcagtgagtggtcatgttgaaataacacacagtaaaagatgtctcatagaaatttgactatatgacgttttaaaaaggccatggggttcattctttcatgctaagaatttagagaaatattcactaacaacaacaatgcaagtataatagcagacacatttcaggcaagaaatcaaaactgttgaaaaaacttcaccgtcccagagtataatgtgatagtatgacacatgtttcttgagctagggataggggaagttttgtgaatatacttctgaaaatgaaaaaccaagcttaatgggcaagagttttgcagggtctccaagtctaaactttaataggtaccacttaaaccgttgatggcagaatcatcaattaagttttatagcagagctgagtaagaaatcaatcaacaaaatattagtaatccatctgctcatcacaacaaattctggcagacaacattattaccttaatgatatgatattggaaggaaaaaaaataaggaaaacggcttagcatctcccaaaggcatgcaatatggttccaaatcaattcgaatttatagctatcctgagttctctataataacttcattccacaaacactaaattttgaacacctttttaaaaagccagaatcaatatacatccaaaacaaccaggtgctctatttacatgtcattccaatacagcagaatgaaaagctttcatattcaacccaagtttgaaaattatagctgtggatatattttcagatgtcgctaggggagcatttataagataccacacacttaagcaagatactaaaataataaatgaagttcaactgaaaaaactgcaaagggataagaggcataactggattacctaagaccaaaaaattgaattcctcctgagggtatccaggaaagctgagctgcaaagtttactatgaaaattcctgtaaactctcaggagactatagaagtcaagaaattagagaaagatgcacatatatgtgtatgaacatttggcaccagatagtgagacacggagacgtgtgcttggaggcagaatgcctgctatttgtctcttcagccccatttcccaccattctccacctgcttcgtgccccgggggccccaggacgctaccctacatgggctacatgagcttcttactgattttggtcaattggtagcagctacaaaagaaaatggagaaagaggtaattattcctcaggcctcactaagtactcaagccaaggctgagaagagaacagtgtatcgaaatgcatcatgttcagtgttgttacacaatcatttaccaccagatagaagctgcagcaggaacttgaacaaagtctggtggttaatgaaccccaggagaatctggaaaagctaagggtatcacacctcagttatcagtcttccttggatttaaaacaaaattctgtatggaacacttcccaatttaaaataaaaggaaatagaccatgagaatagaaaaatacatcctgagaacttattatatgagaaaaagacaccatggccccagtgaattagatcctggcattagaataggaatattatttatttagccttacaatatttgaaggggattttaacaggaaagataaaggaatatgactacagtagagaaaaatttaacagtctttgagaaccaaaggaatctggctggatacccttgtaagagttatgtgggttcaggagcaaaataaactatgtaaaaaggatcataaacaggtgaggtgtggccaagcgcagtggctcacgcctgtaatcccagcactttgggaggctgaggcgggcggatcacgaggtcaggagttcaagaccatcctggccaacacggtgaaaccccgtctttactaaaaatacaaaaattagccgggtgtggtggtgtgaccctgtaatcccagctacttgggaggctgaggcaggagaactgcttgaacccgggaggtggaggttgcagtgagctgagatcacgccactgcactctagcctgggtgacagagcaagactctgtcttggagaacaaagcaaagaaagaggtgagatactacattgtctagattcaaccttggaaggtaagtggaaattttgacataaaaattgggaaaaatggaaatcaaagcaatgaattcccagaacactgtacagaaattatcaaactgcataagctaatgaaacacctacatgacaatttcagcaaaatgaaaaaacaaacccacaaaccacaaccgtcagaatcactattcttcaataacttatggcaaaaaaggaggtaaaaagatgtcatttttccacaaagaagaaaagctgaagctcaaacacagactcggaggttttttgtaacctttgcacactaaatataaaaattgcccttcacaggcacacaggatgcatgcagtgaaataaaagtcctctcgcggctgggcatggtggctcatgcctgtaatcccagcactttgggaagctgaggcaggtagatcacttgaagtcaggagtgtgaaacgagcatggccaacatagcaaaaccccatctctactaaaaatacaaaaattagctgggcatggtggcaggcacctgtaatcccagctactctggaggctgaggcatgataatcatttgaacctcagaggtggaggttgcagtgagccaagatcccaccactgcactccagcctgggtgacagagcaagactctgcgtcaaaaaaaaataaagtcttctggttcataactaggtgtacttgtaaaagttgtttataacttcaacatctgcatgctaacttcacctacgcttggagttactatttaatgaaacaaacaacaatcttttagaggaagcaatggaacattttagaaatgggaacaatgtctcttgtttgcctttgctgcagatgtcacttcctctggctcgtgttagcacagggagacccctcgcagaatcaatcaatttgctttggaacaaatttctgatatatatattatatatacataatatatattttatatatttattatacataatatatattttatatatattatgtatgataaatatattttatatatttattatatatattttatatatttataatatataatatataaataatatacatttattatatgtaatatacatttataatatataatatataaataatatacatttattatatgtaatatacatttataatatgtaatatttatgatatataatgtatttataatatatattatataatgtatttataatatatattatataatatattatattatatattatataatatattatataatgtattatattatatattatataatatattatataatgtattatattatatataatataatatatattatataatatattatattatatataatatattatataatatattatataatatattatatataatatactatatattatataatatattatattatatatattatattatatataatacatattatataatatatattatataatatacaatatataatatattatataatatattatataatatattatataatatatattatataatgtataatatatacaatatattatataatacataatattaatatatataatatattataaaatatattatataatatattatatatactataatatattaaatatataatatataatataatatataatatataatatataattaatataaataatataaaatatataatatatatttataacataatatatttataatatatattataatatataattataatatatatttataatatatattataatatataatatatttataatatatattataatatataatatatttataatatataatatatttataatatataattataatatatattataatatatactatattatatataatatagtatattttataatatatactatattatatataatatagtatatatttataatatataatttataatatatataatatagtatatatttataatatatatttataaaatatgtaatatagtatatatttatgatatatttttataatatatataatatattatatattataatatatatttataatatatataatatattatatatttataatatatattataaatatataatatattatattttataatatatatgttatatatttataatatataatatatatattataatatataatatattataatatatataatatatatttattatatatatattatatatatatataaaactttccagactgactttaagattggtttgatatttttattttctattttactttgttttgcagtgctatgaataattgacagatgactaaaataaccatctttattgttacagcaaaaaccttgatagcggtgtttgttccatagtgcatatttaaaaggctgtatttcagagggtcactctgggctaatgacctttcttcagattaaatatatatttttaaattttacaaagttctgggtattctaaccataagaaataactgaaagtgcataaacctttacaaaatagcaactatcaaattattttacttctacatataaaattagttttattgactaggaaaattgtactataaatgctgtgagaactttggagaaataattgatggatagcagagatttaggtagatatatatttagatagctagctagctagaggatagatatagacaatactacactacactgtgctatgtcatattttaataatgacacgcaaaatgctttccatgcattgttaaatacagggtcttcaacaactctaccatgtgggtactttcctttgatcacgtcatcctgcggagatgagaaatcgtttaaccatgatgtcagccttagtctgatgccaaagcccatatttgatttctttgggaattataaattttaaaacaacttcagatatatagaacagttgcaaaaattgtacaaagaactcttacatattcttcatccagcctcctcaaatactggtatttttttcacgtttagtttatcttcttctctcaatctttctctatgtacattatatagagaaagtaagttaaaaaagaaagtaaactaaaacaagtaaatgcaaagtaaatatatgcatatatacatatttaactatatataatgtacattattatatatctttatgtatgtaattactttttctaaaccatttgaaagtaactttcagataggatgtccctttacccctaaacacttcacttgggatttcctgagaataaaaacattcatttacataaatttttacacaatacttttctcaaaatcagaaaatactgatagaatgctgttaccttattgagcaaatctgatccttacttgtaaattgaaccaattatatctgtaacacccaagccccccaaattgaaccgaggaccacctgctgcattgagttttcatgtactttcagtcccctctgatctggaacagtccctcaatctctctctcatagccttgacattttctgttgagtgtaggccagtttttgtgtagaatgttcctcaatctgggtttgtctgatgtttatattaggagacacatgctatcgtttgtcccaatatttcagctttgatcatttggttcaggtggttcctgccaggtttctccactgttaaggttcctgatttttatttttatgttgaataagtgttttctggggcgacaaggctatgcaaatattctgctgttaatcaaacctctacttaccagttttagtatccattgataatccctgcttgaatcaattattagtatgatggttgccaaactgcagtttttctaaatgaatcaatccttctacatgtggaattttacagagaggaagagacttctaacatttatttatgtatgtatttatttggttatatcatacagacccatggattcctattttttactgggttaacatctattggtcataatatcattatttattttgatactcaattcccctagagtagccaatgggagccctctgaagctaaatcccttgtcttttggatacgtcctcactgttacatgcatccttctttcttttctggtgtaagaaaaatgttccagcctcctattatacttttccggctccaaccccagaatcaaccatttctatgaggagccctagtatttttagtggagaaaatgttcagaaactgagtgccaggtgtattcattcctagtgggatgtcattgcttccagatattctcaaagacgaagctaggaaatgtgtgtgttatacacaaaaatatctttatgacaaccccaagtgcatagtgataactgtgattccaatcaagcatcacagtgtttattcgagactcttctttttcaatatctgtagcttccttctgtgacactgataaatctgactctggttatctcaatatttgttgtttatcaaatttagaatacacaggagttatagaaatgacaactcagaacaaaaacaaaactacttattaaattcatttttatattgagttctgactttatgctaaaagtatgtagtaaataattcagtgggtaaagttatttggaaatttccttttccctttcactgtgccatattatctatttgaaatactattaagttcatttgtttgcatttataattggttttagtttgttttattctgtgtccttgctgatttttttaaacataatacattaacaaggttccaaaggtcaaagctatacaaaaagattcagagaagggtcactgtcctaacctgggccctggctgggcactgctaccccctcgtacctcccattcagttcctactcaccccccatcgggaaatttatctcacttgtttctggtttattcttcccatttctttgataaaaatcagcagacatgcatactttcagtgtggggcctggttaaaaacccacgtgtgacatttcaggcggagcatgggcagttgagcaaagctgccctcccacatgggattcagagcacagccagagccctgcacagtcaaggtttcagagcccccggccagtcaggcttttttacgtactcacactgctacatacctaggtctctagctgaggccctgggcaaggccctcttcaggcgcctctgcagaggcctccttccaggaggaggggaaaccttgaagacatgcttcctcactgtgactcagtccactttgagctctcttcacctggccacagggtccataaaactgctggagccttttgttgggtcacgcatgtccgcacggatccacctgacccttgaccagtgcaccattccatggaggaaacaggaacggaagcgagctggtgcttcctccctataccactccctatacactgcagtgagtgatgaaaggtttaactcattaagggcttgttgctttaaatggctactctgacacctggctctctctcccagctgaggggagctccttactccactccactcagtccccttcactcctgcaaataagataacacaatacagatcacctttcgtattttttttttcactcagcaaggtagtccttaaattactccacctcagtgtgtagaggtctttctcatgcctttttcccagctgcatagtactctattgaatggttgtactctcccggtttaggcaacccctaggttgtttctggtatttttcaataacaattactttttgtataatatcatattgttgaaagacaacatgttcacgttgtagaaaacatgaaatttaaaacatattatcttgagtaaacttgcagcatgattttaagaacagcaacttttgcgattgatccttttgaaaattggaagccaaccgttcaaatttattgtcaagtgtttcctctagtgaagtggtggggaaggtttctttgactgtgagttctgaaatgttaggctaacaaatcgctaaactgtggcagtggagaaaaggaactcacacaagtacaccgctgagcttcattcttctgggagaaaaaaggcttctttgagattatatgattggtttcttttccctcaattgcagtaacaagtatatgggctaaggatgatgatcagaaactagagaaaaaaagagctatgtatcaaaggtaactgcaaagggaaaagtagtatggcaatcccagctttcaggcagaagcgcagaaccaactcaattcagggctgtaatattctcccgttcaaggtccagtttcagccacagcctaattttcaacaggaatggcatttgtaagctggagattgtcagctacgctcttgctgctgaatcctgttttcaatgcatccctcctcccttcctttctcccctgtcaccttccactgctcacccttctactctctgaaattgaagcaaattacaatgtactctatagcattccagctagaagaatgaaagagttattcagatataaagaacataatacaggaaagtccttcagtgagaaaatggtaagccgagaactttcaaatttcaagactgaaagtatgaatgcttatatgttacaatcaatatataaggctgaggtcagaaatcaaatgtaaatgacatattcatggaaagtatctactcgcagggtaggatattcttagagatggaaatcaatttgttgtaaattgactgaagttcatttacacgaaacagaacctttgtacaatagagcataaactgacaagataagtattcattctgagactctaaaatggaaaagaacagttcaaaactgccaagatgaaggtctccatctggcatttcaaatttgctgatattttatgaaagtcagttttatgttatagggcaattttctgccaaagaaataaaaggtgggactaattcttgtttaaaataataataaaaaaaaactgaatccatagcaaaggcgacacatctgttgttgttccaatttattttctgtaagccacattaattatacatatgaatcacatacatgaatttaattcaaattaataatagactcttgaaaatacaggccgattagaaaattactgagcattttttccatcactcactttccatacacaaaatgtaacttgccttggaacccctgcagactgccccttggacaaaatatcctctttgaaaggggataaaatgctcctcctgtctttcttcttgtcttgataggtggaaagtgcacaggactcctgaggtcctctgactgtcccttgccaactttcatctcccatcacgaggagggagaaggttcttatgatggacaacatttgattccttagttgggccatgtctattgctagcagggccaactagaagtagggtattagatccatgcaagttaccctggaacactctcctcgtggctgacccatccccactggtcactcaatagtaacaaccctgagatcacaatttatatatggtgagagcctgaaggttgtcttcggtctcaagcccaagcatgccatggagtcctacctcgcctttaccagggagatgtcatggagctttaggcacaggatcctggcgataaagcagccctcactgctcatctcacagtagtcccttctgcatctgatgctttcaggatcatgcagtaacaagaggggatgggcaggatggatgcctacccaacacgccaactccaccttccgaaacctcacacacgcggctctgaaattcacacacttccactcagtcaactgtgtgtgtgcaactcaaacatccgcctctctcccgggcctgctcaaatggccccttattaacaaagagtttgtcttaaatatctaagatcatagcatgtggattaattttttgtgttttacattttgtgaagctcatttcattattttgtgtggcttcatgaaaatgttgtaaatagctatttttagaacttccatagggagatatatcttatggagtcagctccctagggtggttaagagtctgtacttgggaatccatcagaactggtttgaaattcaggtctgggaatcgctagttatgtagcattaaatgtttgctaatctaggcctagtttacatgcatgtacatgttacaatgaggaaaatgacccttaccacatagaaactatgagggttaaatgggatccaatatgtgtatagaaggcatgtggcatggtgcctgacaatattaagtgccccataaatcatatccattatgttcatgtcataaatattgtagaaaaatctaattctgactaaatgatagaaaatcaccacattcaatgtaacactgaaaattttaaccattgtaactataactaaatatttcaagaatgtttgaaaaaccatggtttaacatttcatgcgatcattcttcacgacaaatatagtttttctcatcagaggctcaacagtatgggcttttgtatctaattaattcagatattttctccattacagtaaaagatccccttgggaaaatcacatccatcatcttctgaaacgttgcctgtcacagcaagggactatatataggcttcaaaatttcatacttaaccttttctgtcacttagcgtttctatttcttttttgatttctataagacaagctgcattcatcttaaaataaaccaataccaagcatgaaaaaagaaaccccgagagagcctctgttgttcctatgtgtcttgctgaggtagctggctgtctatgtgcaatgagcaccatgaccctgcgggaaagatctggaacagagatgaagaacacaggccataataacttttatttttatttttattttttttgagacggagtcttgctctgtcacccaggctggagtgcagtgacatgatctccgctcactgcaagctccacctcctgggttcacgccattctcctccctcagcctcccaagtagctgagactacaggcgcccatcgccatgcccggctaattttttgtgtttttagtagagatggggtttcatcgtgttagccaggatggtctcaatctcctgacctcgtgatccacctgcctcggcctcccaaagtgctgggattacaggcgtgagccaccgcgcccggcccataataacttttagacagacaaagtcaaagtcttgaggctcaatagctggtttaaaacaaatgcacatgtgctcatatcccattcttgggagatgtggttaaaataagaaaaactaatgatgagaggagccatttttgaattacttggagtctaaattatcaaatattttgcaagaaaagcatgtttttattattttcagtcttttatggtaatacgaattaagctctcataatcttgacagatgtgttttaggacctgctttaaaacagcaacaggaatgatttacaattagtatagaaaattgtaatgtgcgaactgatcatttcaaagtgatttctcagtgtgctcagctttttataataatctctaattgtatttatatacttaggatgcttttttgtcctcccaagagccaaaacctatcttgagtatagctctctaccattaaataaatcctacatgagtgggctctgcaataatgagattactatgtaatgactttatgttatctgaaactctaagttaaatataaaatctagagcactacacttagcaagtcacctgtttttatattattattttctcataatttagccttggtgcactagctgaatatcacatcattctttgcctattatatcactacattaaaatatcacaaattcttcttatgtaaagcatcacatgcttccttctagaactttggtgatcaaccatacttagatggtttactgactcatacaacatttcaggaagagctaccaaggtattttctttctactatcagaatgaaacactagggctaaaattctataatcaaatttacatttttatggagaaaaacatgaggtacacagagaccaacaaggttattcatgacttaagcattaagtgccaagtctctccctaaatatcttcctcattcacctttccattgggccctgcatgcctgtgtgttgaataagtaaataataagtgctatagctgttagagtgtcattagaatctccagaaccatgtaagacatgggctaaggagctgaaagaatactttgaggggcactgaagtgtttccaactctggcatgcctcggtgcaccctcaagctcagagatggattgaaaggcaccgttcaaaacaagtctcccagcagcctgctatctacagatcattgaaatgatatactgcaataacttcccctggaacgcttatggcttattgcgctgatgtgtaattaatctgctgagcagtgacaggacccagctgaagagtgcttctggagcttttaagatctggcatgccaaagaacacttggggagtccttggtccacgctttgttagcacaacagactacaacgagcctttaatctgtgattgcacatatgctagataactttatgtattaaaaatcatggctgggtatggtggtcacgcctgtaatcccagcactttgggaggccaaggtgggtggatcacctgaggtcaggagctcgagaccagcctggccaacatggtgaaaccctgtctctactaaaaatacaaaaattagcctggtgtggtggcgggcgcctgtaatcccagctactcaggaggctggggcaggagaattgcttgaaactggaaggcagagatttcagtgagccaagattgtgacattgcactccagcctgggcgacaagagcaaaactccgtctcaaaggaaaaaaaaaaaatatcacaaagtggttttgctcagccttggtctaatgtcagcagcacctgtaagtgcatgtgcatttgtaacctgtgctcaaagttgagaggatggagggacagcagactcttcctgcggagaacaactgtgtttttgtggcttggtcaggcttagagagctcattaggctccagccctgcaaatctgtgactgcagtgcacttctgacttgcagtaaacatggatagaatatagggagagcttggatggaactggaattgtcagtgacagaatgctgactaagtgaccaatgaatcaaaaaaaaaaaaaaaaaaaaaaaaaacagataaaaacaaagaaacatacaaatgatgtctgaaaagagcaaaatcctatttaaagatatgaatgtttttctagatattcttttgtacatgatactgaaaatattttcatttgaatatcaaaaagtggttgatgaagttggatgtagctgataggctaaacatacatatcttggttctttcacaatttcaaagcagttggtaagggacagatatatatgtaggtaaacaaaaaagttcaagcttatcagcatctactaactcgagaaaagcatttcaaaaaacatcttaaatgttgaaattggggagttaacagttaatatgtagtggaattcagaaattgatttttttctcacatataggactaataaagattctccccatatttctacattttaaaatttaggaatgccatgacaaacaagaatagctctctttgaattttctgttaaaatatgtaatgggcccggcgcggtggctcatgcctgtaatcccagcactttgggaagccaaggcgggcagactgtgaagtcaggacttcgagatcagcctggccaacatggtgaaacctcatctctacaaaaaatacaaaaattagccgggcatggtggtgcgcacctgtaatcccagctactcaggaggctgaggcaggagaattgcttgaatccgggaggtggaagttgcagtgagtcgagatcataccactgcactccagcctgggtgacagaacgagactctgtctcaaaaaaaaaacaaaaacatatatatatatatatatatatatatatatatatatatatatatataaaatatatgtgtatatatattatatatataatatatataatatataacatctatatacatcaaatatatatataatgtacttaattgataagaaaacagataattaaactatcatataaaaccacacttaaatgactaaaaatctgatgctttttaacaaaggctttcaaataattggtcagtacaaattcaaggtcatccaatccctttatgctttatgaagactagaatctgttcctctcatactttttgatgtcccggcattacagggaatatatatatatatatatatatattttttttttttttttccttaagctcttttttaaaataatcttttaatttcgtttccatgaacattttgaagtcccttcctccgtgactaaaatatccccacatgctcagataagaaacatattactcatccgaagtttctaggatattactgtgcgtacaaatcacctgatgatcctgctaatatgcagattttgattccctacttctgggatgggttgagatcctgcatttcttctttttaaattttaaatccaggtggtacatgtgcagttttgtacatgggtatatcgtgtgatgttggggtttgggctaccattgaatccatcacccaaatagtgaacatagtgcccaataggtagtttttcaacccttgcccccttctttccctccctactttagaattctccagtgtctattgtacccgtctttatgtccatgtgtacccatcgtttagttcccacttataagtgagaacatgcaattatttgattttttgtttctgcattaattcccctaggattatggcctgtaactgcatccacgtcgctgcaaaggacaggattttgatctttttttttggctgcatagtattctatggtgtatatgtaccacattttctttatccaatctaccattgatgggcatttaagttgatttcattactttgctattgtgaataatgttgcaataaacatatgagtttttgatagaatgatttcttttcctttgggtagttacctagcactgggattgcagggttgaatgggagttctatttttagttctctgagaaatctccataatgttttccatagaggttgtgctaatttacacgcccaccaacagtgtataagcactcccttttctctacatctgcgccaatatatgttattttttgacaatagccattctgactggtatgagctggtatctcatgtggttttcatttgcatttctctgatgattagatgttgaacatttttaaatatgtttgttggctgcctatatgtcttcttttgagaagtgtctgttcatgtcctttgtccccttttaaccggtctttattgttgttgttgttgatttaagtttcttatagattctagatattagtcttttatccaatgcatactttgcaaatattttctctcattctgtaagttgtcagtttactctgttgattgtttcttttgctgtgcagaagctctttagcttgtcaatttttgtttttgttgcatttgcttttgaggatttagtaataaattacttacctaggtcagtgtccagatgagtttttcctaggttttcttctaggattttaataaatcagtgccttacacataagtctttaatccatcttgagttaatttttgcatacggtgagaggaagcgttccagtttcacttatctgcatatgcctagccagtttcccagcaccaattattcaatagggtgtattttccccattgttgatttttatcaacttaccaaaggtcagttgcttgtaggtatgaggctttatttctgggttctctactctgctccattgatatatgtgtccatttttgtaccagtattgaaatgggaaaggttcccttgtccccctagcagggcatgcggtgggggtgtggcttgcttcttcagagccctgctgctccaacctctaggtgaacatacagacgggcaggctgtggggctcccaccccacagcagtgtctcggggtgactgtttacagctcctaaagccccagtgggcgtgtgttacagggtgttctcttagtttgcctacgggcaccttgtgttaatcaactcaattagagcgtctaccttgttacaaggacagagggctttctgtatccccagtttcttgccttggtgtaccagaagaatcagatcacacgttggcttggcgaatgggtgcaaagttttactgagtggaagtatctctcagctgatggggcagcaagaaggaagacggtttttccctggagtcgggctgcttcggggccagggctctcctccgaccgccccagccaaactccacgtggttctgctggtcgcctgccggtgtttgtcggtgtgctcttctcctagcctgctcctctcctcgccctctccacgactagcggcttgcatcttcttccgccgatgtgctcctctccatgtctggccgtctgtgtgtctgcctgctagggtatcgggtttttagagacccaggatgggggtgtggcggaccagggtggtcttagaaaatgcaacatttgggcccgaaagcaggactacctgtcttcacctaggtccatgggggtggagccgtagccagggaccacgccctcctttacccagcacttcccttccctccctatcatttagaaggaccatactcttccctttccagtactcctgtattagcatcatgctgttttggttactataaccttgtagtatagtttgaaatcatgtaatgtaatgcctctggctttgttctttttgcttaggatttctttggctatttggactcttttttggttccatatcaattttagaattgctttttctagttctgtgaaaaatggcattggtatattgataggaatgacattgaatctgtagattgttttgggcagtatggtcattttaatgatattgattcttccatccctgaacacaggatgttttccagtttgtttgtgtcaggtacgagtccctcccttcctccctccctcccccaaccctttttttttttttttttttttttgacagagtttcactctgttgcccaggctagagtgcaatagcacaatcttggttcactgcaacctctgcctcccaggttcaagcaattctcctgcttcagcccccaggtagctgggggtaattgcatgtgccaacatgcccagctaatttttgtatttttagtagagacagggttttgctatgttggtcaggctggtctcaaactcctgacttcaggtgatccaccggcctcggcctctcaaagtgctgggattataggcgtgagccacagcgcccagcccacttatttctattttaaatttttacatttaccacttttttgttaaaaattaaaacagagttttgtagttctccttaaagagatctttcatctccttgattaaatgtattcccaggaatattactttttgtgtgtaaggctcttgtaaagcgaattgttgtcactatagtgaacaatttttagactcaggaacttctaaaaccacatagatgcttcagttctgaactctagtgaccttggtgcagtcccaaacaaagatctaacttttacacctaagaatgaattttgagttcatcgaagacctgaagtatttgcaaaaacaaagagaaagcagtcttataaattagactaaactgtaagcatctcaaaaataagtccagtgtttcattcctttgttgtttatagtcagcacgtgcaccaaataagtctttttttatattatgaaacatttattacatatttttatatatgtatataacttctatacgtttctatgttgtgttcatgtccagattgtatttttttttttttttttttgagacggagtctcgctctgtcgcccagcctggagtgcagtggcgcaatctcggctcactgcaagctccacctcctgggtccacgccattctcctgcctcagcctcccgagtagctgggactacaggcacctgccaccacgcctggctaattttttgtatttttagtagagacggggtttcaccgtggtctcgatcttctgaccttgtgatccgaccgcctcggcctccgaaagtgctgggattacaggcgtgagccaccgcacccagtctgtatttttaaattatgtattatttataaataatttcagaagattagtatactctcatttgaccatcaaatctgcaaaggtacttttgttttcttccttcctgtgcagtacagaaagtgagccttttctaatccgtgtcatgtctctccctatatactgtccaattcattccatctttttagtgacttccttctattgactaccctttcttgcagtgtcaactttttaaggaaaccttgtcagtgaattctgtgatctcccagtggccatatccatggtgctttttttttttttttttttttttttgagacggagtcactctgttgcccaggctggagtacagtgccacgatctcagctcactgcaacctccgcctcccaggttcaagcgattcttctgcctcagcctcctgagtagctgggaccacaggcatgtccacacctggctaattttttttcatatttttagtagagatggggtttcaccatgttggccaggctggtgttgaactcctgacctcaagtgatccacccgcctcagcctcccaaagtgctgagattacagacatgaggcactgcccccgggccatggtgtgtttaatgtgcttttaaatacaggagcaatcaaggcttggtagatagggagatgagggccaaacaagcagttgcaaaccactattgcagtcaaggaaaggttaacaatcctttcttagcagaacagacatgggctcgcaggtcctgtcaaatgaaattacttgtcagcatagctacatgcagaatagttcaacagcctggaagccagaaatctgagcttcttcatttcttagttctttcagtgaattgctttgaaatatgttgacatctgtgtaactttgtggactatcacttccgcaactccgtgaagacagagaactcttatatgtattcgcgtattcatagacacatgacaaatggaaggcaagttggctttccctaaaatgcggaggcacacgtgtgatgccttctgctaacactgcaattatgtactcataatctctcattgtaaatagaggcagatgaagccactccagctctacgtcaactctcctggaaagaaccagaatgtaggtcctgtaacctactgagttttcattggcttcatgaacacgtatgtcctgcaatcttgtggacctgtaagctcttcatgcattaagacacattcactttcagccacctcaactttcctaaaagagatgcttttgctgtaaatattctaaagctatttcagtcaagatgttctgaagctatattacttagaaaaatgcttttagtagggaaagtggagctccctaaaggcatcttaatatgtacttatctgctttgcttttttttccccccacaaatggcattcatcaaaataagttaaatagtaatggcttgaaacgtaattgtgctgttgtacgttctccaactgtgtacattcaacaaaccttggaaaatttcagatcacatgaagagcaaattattggtatgttgttggcaatcaggattaagttgccagagtcatgttgcttaatagcttgcttttcataaaataatgatggtgagaagttaatatttattgagtctaccgtatgtgtaatggactgtacttcaggcattttctcatttaatcatgataacaaacctataaactagaaaccactttgaattcctagttaatagataatgaaactaaaaaagagagataagcaattttgcctgtggtcacgtggtatgctgcggtctagagctgggattcaaatctgggcttctaacttcagaaccctcacttatgacctctctacaaattctgctctccccaaaacccatgtcaatcgttagtgtttcaagactctaagcattattctttctatatcaagaaattgactgtatttttagtctccatacttcataggaattcatcttatgattcctatgtttttggatatcctcctctgtatgtttaaccatgatattaatcttgacatgtttcaatgttataatcacagaacaccctaagttgatgttttgcaccatcctcataaagtaaccatgtttgtggtccctctgggcatctatcctgtcagagaattgctctgatttccacttattttcagttcctgcgagtgcgacaaacctctgtatattcttgtgtagaaaaaccagtcctcaggcaaaagtagaataagtaagcaatacctttatcctgttacaaaactaaagaaatatcagcaatttcttcaagagcaagctcatgtcacttcatctgttaatccttcctgactatgccaggtgaagttaaccacgcccaaatttgtgtttccagatatgccatataacactgtaagtgattatactctgcaatgttttaatacatctgcctttctcataagacaataaatacttgctggggggtgggaaggggcatgcttatttctatattcacagatcttagcacagttgctgaggttgcctccgtgcttaatacatggttgtggaaagtagggagaaagtggagaggaggaagaaggggcagaaaaggagagagggagggaagaaggaaggtggggaaggaggaatagattaattacattaacttggagtgtggtttatattcatactagatgttttgatttttccataatttcccatattgccaggataaaaaaaaatcacataagaaatatactccgaatactgcctctgacccagattccaaagaacagaaagaaagatggtcagaaacactgagaactgtcatgtcattaggctttccaggagaattctgtacagcttcaactgtgctcttttagaaaagccaggtgttataaaaacttggttgtttattgacgtattttatctaaaacatggttttaaagtgtgtgcgtgtttttaacctgataggtagaagctagaacagctgccatttaaacattgccatcagttttctatcttctataatgtggaggcttaaattcccctttggaacaagtatgtcaatgttttcagtgaaccatctaaatggacattttagttaacacaaagtgaaagcaaagtctgtgctctgaaacggagaggtttggggcgaggcaggggaagacaagctgcaggtgcatctttgctggttctatctccattgatgacggagccctgggccggctgctgtgtgctcctgtggaggtgtgcgtggaaacttccgggcacggaaatctttctttaggaaataagcagtaggcaagagatggaagaagctgcttcctttgagagactctgaggagctacgggcacaagcattattgctttagggagctggctacaaaatggagcagtgaatggagggaaggacgctgtccaaagccacacagagcccagcatgtctgggcacccacaggcattggcttgggaatattgggagctactaacctggaagtggatattggtgttttcacatgggggacccgtagcaaagccaagagggtggcgtttgactggcttcagggtgacagcaaacagtggacatcgcccaggaggagagctcaggaatgaaacatggcacaagccatgtggaaaccaaagagaagagggtgctgtgaacgcacatttcctgagctctttggagagtcccataaattattactgtggtgatgtttagaatgataggatggaatgtaccagaaattcaggtggaacaaacatatgtcattggaagtttagcatcaaccattaaagtgactgtatttgtgcccaaatacaatcagaactcctgtggcaggccagttatttgccctgcccttactagtagctcccagttctccctgcacttcagaatcacccaaggagctctgcagaaacaaacccacccacctccacccccacacatgatacagagaaattcagtcactgggtctgacatttctattttttaaaaaagaaaactttccaggtaattctgtcttacagatacttttattaaaaattgggttaaagtttgcagaaatcaattggggatacgcaacatcaaatatttaccatgaaggacctttcttcaaggttgtattttatgtctctcaatcattagtaaggcaagttcctgaagttaagggatgtggctttcacatccttgtatttcccacaggaggtaatgtgtggggaaatgaaatgcgtacttgtgctgctgaaatggcctatttgctcatcccagtttcctcgatggcaccgtgcaccgcactctagttcatccatgccagcgctctttgctctgctgagcaaagttgttcatgaggtttggctccctctctgctgggattttgcctcatcctttattctcaaccttgaccctgtccaatttgttcccactaaacgccataactttgtatttgcttaattgtcctggattatcttgggcattatttttgttgttgttatcattggaaggtgttaacaactccttcctagtatacaccataatataaaaacacattaattatgacatctcagtaatttatgaaaatagcaaatgctagtcccatgctttgtgacaggatcttgctctgtcacccaggtgggagtgcagtggtattatcatagctcactgtaatctcagactcctgagctcaagccaaccttctgctttagcctcctgagtagctgttactacaggtacacgctatcacacccagctaattaaaacaaaaaatcgtagagatgggctctctctatgttgcctatgctgtgctaaaacacctggcttcaggcaatcttctcacctcagcctctgaaagtgctgagattacaggcgagaaccaccgtgcccagccgctgcacctttctgttccatgtttttctcagaaccccccaaatttcccagacagctggctgaaacttttaatacatccctacaactaataatgccactttcttcccactccttgacaaatgatgttgcctcccatgttactgcagctccccgttatctgcccatctccactgatgaaatcactgctgggaattagaggtactctgaatgtaaaacggccccagttactggaaagatctcagaaactgtcattagtcatggctgcctcatgctctcatctggctggtcttcttaatgtcactgtaacatgtcacagtgatttgcatctttgcacctttgcaggaagccccttcctttcctggaatcaagccttctttttacccttgtacagttacaagccttcctccaaccttcatggtttaaggcctttccagcacttgccaaaacccttccctgcacactccctgttctaagtgcaactttttctgctgtctcagaatttgggcagaggctctgagtctgagaatcattgttcctaggcagttacagagaatgaaatgagagacctgagaccctgggctcacaccctgaagacaagggagcaaggtgctttaagaggaccgcagagagagagctctaggtactggaatttgtggatgtacaggtgatggacaccctcctggagaattaacgaaacatctctatcaagagcagattcttcaagagtgcagtctatgaatactgttcctgatcattacctctcctcagctcactccagcccctccaccctaattctggaggagccacgaaaggagtaaatggggaaggaagaatgagagaacaaagaaattaaaaagaaactatagcgcatttcctcctctaagataagactgagtggtgagagaggaagaagttgacattacataagtaacactttgatgttggccaacttgacattttgataatggaaaataaacaatgcagctgagatgtccagctcggatgtcctccaaggcctgagaaggacaattctagagtgatctaggaatggtgagaaagcctttggcttctttctgcacacacctttccaagggcacctattttttttttttaatgataacaaatggtgacaagaatatatgttatcattcaaattagactgcatgtttgaaataattgcccagagtgtccatctgctgctgtgggtatggaaggtactcgatcattattggttgagccccatcctccacatccctctcaacatctaatccttttttttatctctcataggcaagagcagcatttatagtcaaagcttatttacaaatattatgatgcaaaagtaagattatattcaaaaggctgccaaaagagtcacttttctttttcttttctttttcttttttttttttttgagatagcatttcactcttgttgtccaggctgctgtacaatcatgcaatctcagctcactgtaacctccacctccaaggttcaagcgattcttcttgcctcctgagtagctgggattccaggcacgtgccaccatgcccaactaattttgtatttttagtagacacaaggtctcaccatgttggctaggctggtctcgaactcctgacctcaggtgatccaccccactcaacctcccaaagtgctgggattagagttgtgagccatggtgcccaactaagagtcacttttttgtggatcgttgcatgtcctgaggatatatgaagtcaggcaacagaaagaaataccatgtcaagataattcagaacccagttagctgaaagcttgttctactaactacatgtgaagtaatgttctagttatttcagctgtaattccaaattcaaaattgtttacaccctctggttgcctttgtactcatggataaaacataactgtgtcatcaatattatctggctcataacagcttgctactaatgctgcaaggttttcaaacagctttagccgacagcacaagcagcgcagagtttcttaagggttaatttaaatgtttatatttaagaagcatattcatctccccttacaatatccatcagccatcttgcataaatgtatttctgctgctgtcataccactctttggagaattttatttttaacaatgaaaataataatattttaaaaccaccaagcaaaaacaaggcaaatatgatcataagattacctagtcatatacttttctctaaaaaccatacctattttgttctgtagaaaaggaattctaaggcagagatgggagtgaaggagagaacattttaaaatcaggagacaacagaaaacatgtctgaatcttgaggcaaagtgggggccactttgcagcctaggccagtttgtctgtcaaccacctctagagaggacaaaataatttcatgtttactagctactatctgctggttatcttacgtatataacctcattccttctccttgaaaatactgcatgattatcgcttcatatcgatgaaaaaagcgaagctgagagaggttaaagtaaaatgccaaggttctgcagtatagctaacggtcactgctcttggctcctttttcagagaaagcatggctagaagatcttgaaagttacagaaagccccatgagacaatgactcatctctgatgtgtggcagaatgagaaaccacacttacagtggtatcctcatcactcttccattgaaatgaacccaatgctcccacatgcaatccaacgagagataaatatgacaaaacaaagaaagctgcatgtttgaagtgctttccaagatgtcttaccacactcctgattgggactgtaatatccaagaagcttgacccaatttctctgagatcctggctttcccctaacctgacactcttgttttattcttggtttagagaattcttgcccaatctttctgcctcttttattccagacactggctcctctctcagctgtctcacatgttatgaatgatctcgcctccatcacttttcacagctctttacaagtgctgaccatggatcatattcgagtgtatcagggtctaggacaatgtgtttacattacagaaatatgactggctttcacccttctgaaacatctctttttatggaagacattcattgataccttcagtcttaaaaacttgttggcatagaagaacaggaaactggaagaggagttttttacttttatacttttatttgctaaatgtgttaaacccttaaatgtgctacatatgtactataaggaatgcacaccattggtcaactatcataatttatgctctgtaattcacaatgcatactttatatatatgtgccttagttataactaatatgcttctttttttctttaaaaataatatagatcaatgatatttaatgtttaaaggaattttaaagatcatctagccccaaaatatcatttcgtaggggaatttggtcaatatctctttaaagaggtagaatggaaagccaggttcctgagttctaatcattcccagaggttctcttgtagttaaagcatgattttttaattaattagctttcatcttagaaatcgttttttatcataaagctaattttcagacatttggaaaactgtgtgagttatcaacagatgaaattatgctgttcactcatttaactgttcattgtgtgttttccttccatcttttctatcttgtttatttattaatctccagaatttagaattatgccttgaaaacaaatatttgtagaatgcatgaatcaatatgcaaagtataagaaaggtctctctttgaattctgacatagccctatgaaatattataacatggaagctgccctttgatgtaactggtcctaattaaatcaattcagataatgtagtataaacgatctttgggaatacagtatcataatgtttgaaagttatgaaaaataaaggggagcagcaaatatgcatttttaaaagctatacacaaaattggcctcgctcacagggtcattcaattgtgtgtgtgtgtgtgtgtacacatacatatatatatatatatatagagagagagagagagagagagagagagagagagtgtctactacatgtcaggtactatattagttactttatatatttagcacctcagagcttgctgaaaacaacccttatggaagatgctattattattccctatgttaaaagtgcagaaactgttttcaaggtcactcaaaaagtagtgctggtaaaacagctagaaactgggtgtttcttgctccaatgcctttaaggctatactgtgctgtcttcataaattgatccacaataggtagagacaagtagaaacaagcatatttcctgcagtttattcatttccttcctatctgtttttgcataaagtttcacttataaaaattacacaaaacttgaaaggtgaacaggagatattaggcttagaagaattccttatgatgaagaacactttggtactgattttgttaacacacttttccaagtagccttataaatcaaatagaaataataattttaaaaaccctaatgactcaacatacttcattccaattgaaacctactggatacatgtaattcagagaacagattcttctcagttaactttatccaagactctaactttttcagtcaggaaaaatatagcccatatggaatgttaaccttttatcacggaattatgatttcatagcttcaaattgctggtccatgaggaataacagccgagagcttacatatggaggtaacaaaatgttaatgtcttagtccttttgcattgctataaaggcatatccgaggctgggtaatttaaaagaaaagaggtttagttcgctcacggttctgaaggctgtacaagaagcatgtcaccagcacctgcttctcttaagagcctcaggaagcttccactcatgatggaaggtgaaggggagtctacatatagagaccacatggcaggaagagaaagacagacagagagaaagagaggaaaggggcccaggccagagagagatatatatatatatagagagaggctaggctctttttaacaatcagttcttgcaagaactcatcaagtgagaattcactcattaccttgaggaggcaccaagccattcacaaagggtctgtccccatgactcgaacatctcccaccaggccccacctccaacactggggattaaatttcaacaaaagacttaaaggggacaaatatccaaactgtatcaactaaagaattaattttgggggtgctaggttttctcagaaactaaaaaatgagatataacttgccattatatgatctgtgtttaaagtacattctctctcgtccatatttctccaggatgatatgcttaacttaggtgttaaaaataagtccatctgatttattttcaaacttcataaaaaattatagatcatgtagaaaaattaatctgtgtgactagtaaaagaaaatgtgacagcaatttggagaatttactatagcagatattaaatatgttacaatgtattaaatgttagagggatcaaaataatacagttttcagggcagaatgagcagaggaatggaatagaacagactcgagagataagaccctcaaggttaatataataaaaagatgagatttatttcaagtcaatggggaaacatgttttattcaataaatgatgcataaaaagtaatttgtagatttttggtgagaaataagtaacattagattcatagaaacccttcacactaaaataaaatctgtatgaatcaaatatttaaatgttttaaaaagtgaaactgtaactagaaaagattttcattaaatatctccaagtgtagagaagatcctcctaataatgataacaaagacataacgccataaagaaaacaatacggccgggcgcggtggctcacgcctgtaatcccagcactttgggaggccgaggcgggcggatcacgaggtcaggagatagagacgatcctggctaacacagtgaaaccccgtctctactaaatatacaaaaaattagccgggcgtggtggcgggcgcctgtagtcccagctactcgggaggctgcggcaggagaatggcgtgaacccgggaggcggagcttgcagtgagccgagatcacgccactgcactccagcctgggcaacagagcgagaccccgtctcaaaacaaaacaaaacaaaataaagaaagaaaacaataattacatcaaaattatagtttaaataattttgttttgagatagagtttcactcttgttgcccagggtggagtgcaacggcaggatctcggctcactgcaacctctgcctcccaggttcaagcgattctcctgcctcaccctcccgagtagctgggattacaggcacctgccaccacgctcggctaattttttgtatttttagtagagacagggtttcaccatgttggcctgacttctctggagcttctgacctccagtgatccccctgcctgggcctcccaaagtgctgggattacaggcgtgagccaccacgcctggccatctgaaataattttgaaacgccttaaaaagacctgaaaattaaattacttactggtaaacatattttcaacatgtatgacaagaaatggtttcatacaagaatatatgaaatggtcataagaaacaaactataagaaataatttcttatacttactgtaagaaacttttatctataccgtgcaattataataaaagaaaataaccataatagtaagcaataaataatgaaaatgtattcaagcttcctagtaattggagaaaggcaattttacatgagatgtcatgtttcacctaaataattggaaaaattaaaaagaataaaagcacccagtgttagaggatgcaaagtaaccatactgacatgtagtttgggggaaagtggaaattgatggaaactttccagggtaccttttggaactaaggactctaacacattacatgtaaaatattttgccctttgcaactctactcccaaaattatatttcaaaaatgtgactagacaaattactagagatgtgtctaaggaagatcactaatgtgctgtttttataatgaaatgtagagcagcctataaacttatcaatgcaagactcttcaacaaaataaatgggatgcatcaccaaatgtgctcatagagacctgtatctcttgatatggataatgagcacattatatgaagtaaaagatgcaagttataaaataatacgtgagacacaaaaacaggtgtatgtgtatgtgtccgtgtgttttcatgtgtacacacacacacacgcacatggaaaacagacttggaagaatatgcacccagtgttaatagtgattatctccaggcggtttgattcaagaggttttaccctctgctttttttttttttttggttttgagacggagtcttgctctgtcaccaggctggagtgcagtggcgtgatctcggctcactgcaacccctgcctcctgggttcaagcaattctcctgcctcagcctcctgagtagctgggactacaggcacacgccaccacacccagctagcttttgtatttttagtagagacagggtttcaccatgttggccaggatggtctcaatctcttgacctcgtgatccacccgcctcagcctcccaaagtgctgggattacaggcatgagccactacatccggccttaccctcctctttaggtgaaagtacgttggctaatttttttttcagccaacattatgtttttataatcagaaaatgcaacatttattatgaaaataattcaatgaaaatgaggtataatagttttaaattacacatctagtatgacatttaaaaatgtgtggtattctggtaataatcatactggcacacagttctgaaaaaaaaaatagaaaccaataataaaacttttcctaagccattatgaccatgttattttttcctccagatcaactggtatagattattatctatgtcataataatctgttatataaaatgcaaattaagtacatttttatttaagaaaattacaaatgttacagtttggtacaaagttattgtcagagccacttaatttgaatacatgttatttgtagaaacggcaattgactgtgtaggaattatggcaaattgattgtagtctttgtggaaaaggctggagaatgccaccttctgaaatcaaacctagtaaaagtcaacacattataacaactatggtcataataactacaatttattgatcccttacaatgacaggctctgaagtaagcactttataccctttatcagataatgcttaaaacagctgtgtataatagtcacctatacatctgtatcaaaatatggaagctcctagggttgcaaaggtttcatctggggccaccagcctgtaagtatcataacaaaagttcaaatcaagtttctctactgtctgagctattgtctactaggctacatactaagcttcgtctcttttagaggaaaactacagaaaaataaaccatcagataaaatcatttgtaaatatgtcactgatgttgacttgaaaaatatgtacttagaaacctaagagaccagggtataacctcaggtagacatgataggatcacatttgatagatatataacttcatttcaatgccttgggcatgaccaagttgtgcaattagtaaccagcaagaggtggagttgacttgaaagtccttgctggccgggcgcggtggttcacgcctgtaatcccaacactttgggaggctgaggcgggtggatcatgaggtcaggagatcgagaccatcctggctaacagtgtgaaaccccgtctctactaaaaaaatacaaaaaatgagccaggcgtggtggcggacgcctgtagtcccagcgactctggaggctgaggcaggagaatggcgtgaacccaggaggcgcagcttgcagtgagcagagatcgcgccactgcactccagcctgggcgacagagcgagactccatctcacaaaaaaaaaaaaaagtgcttgctactgtttgtctgacaccattcaatgcaaagatatactttaaatatagaaataattctagccctgcctgaatgaactctctttcaagatcacataactctacttcggatgctttgatcattgctatggtttggatatggttcattcggccccaccaagtcttctgttgaattagatccccattgttggaggtggggtctggtgggacgtgtttggatcctgagggcagctccctcatgaatggcttagtgccattctcaagggagtgaatgacttctcattgttggttctcctgagaactggttgttgaaaggagcctggcacctccttctctctctcttgtttcccctttccccatgggacctctgcccagaagactcctcttcaccttccaccatgagtggcagcggcctcaggccctcccccagaagcagatgccagcgccatgcttcttgtactgcctgcaggactgtgaactagataagcctcttttccttataaagtaagtactcaaccttaggtattcctttatagcaacacagactaaacaattatcattgtctgttgctaatttgagccccctttcaataaaactatgacgtacacacacatatgcacacaaacagacagacagacagatgtatatatcaaagtgtgtatagtcttctgtataacagcatgatcacagagaacactgtggaaggtatgcccgtcatctactgctattcaacaaaccaccccaaatgttagtggattaaatattttttagttcttaaaaattaattttactggtaaatttaaacaggattaaattaaagcagcatttggtgggcactgcttgcctctgctctgcttgacaacagctgaggaggtttaaaagctgggaggtggaattgtctgaaagctcacttgttctcaaacacgatggttgtcgatgcaaagactcaaactgctgggagctggtacacctgggttccttagccatctctctccatttccatgtgcctttccctctggtctctccagcacagaagcggtaggaaacctgggcatttacaatgttgtttgggggctgctagtgtacaggtcaacaaaagaggaagttagatgctactttgccttttatgatttagcttcagaagtaacagcataagttctactgttttctgttcttagaaacaagtcactaagtctgacctaggtctgtggggagggaaattagaaccacttttttttttttttttgaaatggagtttctttcttgttgtccaggctggagtgcaatggcacggtcttggctcactgccacctctgcctctcaggttcaagcgattcttgtgcctcagactcccaagtaactgggatatacaggcgcccaccaccatgcccggctatttttttttttttttttttgtatttttttgtagagacggggtttcaccatgttggccaggctggtcttgaactcctgacctcaggtgccacccacctcggcctctcaaagtgctgggattacaggggtgagccaccatgcctggcctagaaccacatttttgatgtatttatgaacctgcagacatatttttaaagaaccacgcaaggatgaatagcttggtaacattgagggaggtcaagttagtggggagctgcccaaggagaacagtagtgaggaagaaaaacaacaagaatcagacagggacagagtggagggcaggagggaaagtcatgcagctgagagggaagatatgaataccatggaacgttgggaagccgaggtgggtagatcacctgaggtcaggagttcaagaccagcctggccaacatggtgaaatcccatctctactaaaaatacaaaaattaacccagcatgatggtatgcgcctgtagtcccagctactcgggaggctgaggcaggagaatcacttgaacctaggaggcaggggttgcgaccagctgagatcgcaccactgccctccagcctaggtgacagagtgagactctgtctcaaaaaaataaaaaataaaaatgaataccatggaattggagctgttcccagagtataaaccaataaatgaacatcatggttcatagtctactgtgtattagatagctcatgagttcgtctctttaagaactgagttgctaaaatttagttcctgaacctgtaaacatttggactcatggcaattcttaccacttggtggccattctcttcaacatgtctttagccacaaagcactatttgatggagagagtaaagacattccatttcttcagctcctcttaaagctccaaatgcctccaggccccacccattcccccacctctctctctttctaaacagagattggttctcaccatttcaaagggtttaggttgttactgtggtttagtttagctttgctttgttttttgaggtccacctgtcgtatctgtgacagaatttgcaggaggtactccagttgtgatcactgggaagaaaatgcggtgaaatcagactaacccatagttctcagtatatcattgcatggcttctaaggaaccacaatttaaacagtgcatgataaccagtattaatggattatagcccctaaattgtaacaattgtgactttgtagactcctaagtatcttctggtttgggtaacctttctattatttgctttcttgggatctgtcagttacagtgtgcatttagtcccgtacgtgtggctgacatatcctatcctagagtggccacttgtttagaacagttctattgatcctgcatgttccctaggaggaaacacaaggccttgctgagaaggctctcaagcttcactcccatgcagtatagtttacatttctagttttgtgatttagttctcatggagccataggccataattactcagctgtaatgaacctcacaatgcatcaatgcattcttctccatttatatttgcttttatttgaatgaaataaattcattcaaataaaagcaaatataaatggagaatacattcacaagatgttcacaagaattataataacataaatgaaacaaacatttattttattgaaataaaagcaaacataaatggagaaaaatgcactgactatggttcatgactgaaccatagtccttatttatgagacacagtcttgctctgttacccaggctggagtgcagtggccaatctcagcccactgcaaactccacctccggggctaaagcaatcctcccacctcagcctcccaaatagctgagattacaggcatgtacccagctaattttttttttttatttttcatagagatggggtctcataatgttgcctaggctggtctcaaactcctgggctcaaacaatactactgccttggcctcccaaaatggtggggttataggcatggtccactgtgcctggctgaaccatagcccttttaagcattgaatgcatttaaaatattttcattgttctatcaataaaatatccacatttaaatgcaggccttataataattaatactactcactattaaataccaaattagaattgattctctaaagtgtcttcatatattgtacattgtgctaggtaatatgagttttaattgcttaatataaaattacttaatggcacttataattcttgtgaacatcagtataagttttaataaaatggtagaagcacatggagaaatggttctttgattgttaaaatagttcatttttataaggcaggtaagaaattagtaagttagataactacattagtccatttgcatgctgctgaaaaagacatacccaaaaacaggaagaaaaagaggcttcattggacttacagttccacatgactggggaggcctcataatcatggcgggaggtgaaaagcacttcttacatggcagtggcaagagaaaaatgaggaagaagcaaaagcagaaacccctgataaacccatcagatctcgtgagacttattcactgtcatgagaatagcatgggaaagaccagccaacatgattcaatgacctccttctgggtccctccagcaacacatgggaattttgggagacacaattcaagctgagatttgggtggggatatagccaaaccatatcaataaccctgaggaaaaaatcacaatgctgggatccagaaaaatatagatgtttttgaataaggtttttgaataagaaaaatctccatatatacacagttagataaacccaacagaacatccttcagttttgaaagccaaggaagcttcattgaatcctgtgtctgcataaatgatcagtgaaatttcaaaattcactgatgtgcagtcttgcttcacaaatggacaaatggagatgaacagaggccaatggccatggacatagaaggagaaggagttacagacagaatcccaaactctcaatccagtttctcaaactgtccagcatgtagttgctattgactcaattgtcctttggaaaggatgaagtctcagatagtctcaaagttcactttacatagtaacccattttgtctcccctctaatattttgaaaaggtaacggcaacagaaaagggtcctcagttttctaggaagattgacaagaaggaagcagcaggaagagaaaggcaggaaaatcttcatactggatcatccatttctagcgattatagataacagagttgctgataaagatagaatttcagtcaaccactaagcagattcccactgaggaacaccctggagaaacacgaacagtcaagacagaagaccaccagatggctgatcttaataacccaataaatacaagaaaagagtggcacttctacccagttctaaacgaacatctcatttgtatgttgtgttctgagttttagggaagacaaaaatgccaattctaatttacctttattcacactttgccagggattcaaggaaggcagaaaaaattgtacaaaataatcttttgtttttgttcccttcaagattctcttttactctttttgttccttatgccatcactccaccacaaccatactacagacttcgcaactgctgtctcagcctttgaaacacctaaacttcaacatgctgagattacgcctattacgctaatgaacttctacaggaacgaacaaacgaaaaggaagtaatgcaccacctcctgtttctcagccatcaccacctcccaggtgcttcccagagcagttccctgctgccacggggctcctgcaggagctcctccctgctaggcatgtcctcaacccctagtcatcaagtctagctcagcctctgcatttcagctcaacgtctaatttcccagcgtagattccaggcagccgccctgtttcatgtcctcttaacatcctctgcttttctatctcatcttccttcttgacaagttcaaagtcatgaggactggatagagctccatcaaagcagggaatgttgattttatacactggagctgagtgggcagtctggcacagagcaagtggccagtaggattacggaatgcatgaaccttaattttctattcctttattcctgtcatttcctgtacctcacaaaatgttcccaaccatgccaacatcaccacctgtgaaaatcccaccactcttcccttgggcctcacctccatgaagtcctctttgatcacctttgtgttttctgaactccataagcactttctatgcgtgtttcacatcactcatgatatactaacttgtgttatttcctctgccctattcacagagggaagtccttgcatggtccttcacatccaatcttattagcatttaggtcatggcataaaaatcatcgtttgcctacacgtctcactccatccccaatttttcccaaactatgaaagcagtgaattcaatactcgtttttctatcttagtgcttggcacagaagagatgcttggtaagctttttacttgctctgcggaatctgaattgcagccatttttgtgaagtcttctctactcggctagattcctacatcctgaaagtcagtctttgttttctgcatagtgactagcacaacaaatcaatgtgttataaaagttatctacatttctttcaatggaaagatgcaaattttaaaaacgatcttttgcttttccactcttgaaacataaacattttctctgtaccttgtaaataatacttgcgtaagatgatcaccactgaagttattttcccaaaccctgagtattaaggggaatgatgactgcctacttgaggaagctcagatgatccgaagatcccaaactatgttcctttctccaagaaacattagtggaagggagtgtttcaccacatgtgggtcaacagtacgtgacatcgtctcagttgtgatttgattctccatatgcttataatttccattctaaatctcaagtttggtaaactggctttaagggatttttgccacatatatcttaaaaactaaattttactgtggctcttgataactttttgagagctagcttgacctgagtaagacagatgatagctccttaatgaccgccatcaaggcatgatgaagtgcgggtccctgggagccatcaatcacctgctggaaggactaggagggctgtttcccggccgagaagcaggcctcaatctcttggcccattactctcacgtcttccttctattcttctcactccattaggctcctgtgtatctgcactgaggctatctcagagtgacctcccatctctaatccttgatatttccatttgggtctaatgtaccatctcgattgaaacatttgggaaagcttacagcggtatttaatctttctttgctctagttctcagaatctcatttataaatctatttgaaattatcttttttgtatctattactatcttttccagtagatcgatatgtactctctcctaatctaaaacctagtggtctagaagcacacctctttctgagtaattgtgataaagtgctttgttgtttctttgttttcagggcctttgtctaaacctgcaatgcaaccatcaacacagcctcggactgacacgtttggcttttgaatcattctatggaaaggcaaaaaacgaagtaagacttttgaagcctctggggtttataaaccggtataaaattcctcatatttgaatatgttgtagtaatatgcatgattttgttctactgcacataaagtgcgatacaaactatagaacagaagatcgcagatcatcaagtgtaaaaaacagctgacattcaccttgactaggagtttcctagaacagggaagcaagaagtatgtattttggaagctgcatattgctggaaagatggcgtcatagactaaaccaaggtcatgttctgtgatagcagtgtgaacactgttatttcacacgtgcagattctctgctacagccgcactggttctggcacctggttttcttcctctggagattattttttcatgtagcagtttacaaggaatctttaacactaccatgaagaagatggctgttaattcaattttccaccaggttataaaagagccctgatgaaaaagaagttatgtcatggttatctcacagaaaaaggagaattaaattaagcttagggttcataccatcattgacacttttttccatgggaaactaatgcgttttcatatacaaacgaaattttgattcaaatttgcaaaatttaagctaattctgtaataaaaatctatcttctaattttaaccttaacaattaaaaaaaaaaacaagaaattttttgttatcaagtattcaaaacttggtttagaaataagctgtccttgagtctgaatgctggattgggtttttgaaaaatgttctaagaaaactttctagtttgtcaccccaaattgcatgtcagacaacagagaacactttgtcacgcttagacaccattcaatcataatctgagtttgacttcaaagttttcacaattcaattttgtttagaattaagaaaacatgactgtggggaccaacgtaagggcaggcagagcatttctcttcagccaaacaccagggcagaaggaaaaggggagtgaatgagtccatttgtcctttacctctgttttcattttccactctctacatttaagtgtccagctgctctttgaccacagtgggacccctcaaagccacaaaggctggaattgcttaaatatatatttggagatgcttgtgctgatagttattgtacagtgcagacgagcatgggcaacacaagaatatggagcccacggctctcatgctgtgcaaatgaagaccgtcatttgtgactatctcagggacacttttcaatccaagagcatttcttaaaaacaaaagcaaaccaaccttttattgttattagacaccagaaaaaaaaaaacccaaaacatacagttcacacatgaaaccatcctgagaaattctgagtctcattttctgtgattctaatgaagtctaaaacaacaataaaaacagacaaaagaaatacagattccttggaggatagtaatttgatcaaactaaaacattattaagaaactttttggacataaaatacggaaatgacttctgacataaatcacaattgctcagtattaggagacttatttgctattaattttgtttcagtcaacatctctcaacaacatgaaatcagaggtgcagaccatgaatattaactttcattcaaactaacgttccagttggcatatactgagcctaagagggggaaagtgtgaaaaatagattgcatgttgagtaagatgaaaacactctatttattatactgagtttaatagttacattatttattatagttcaggggatagttttaagtatctaatttcatttgaaataaatcttggagttattgtaagaggtgttacgctacttgttctgataagaaaaaaaatgtttgatgtataagagttgaactccagtcaaaatcaaataatctaaaaaagaaaatgttattttacataacacttcaggtaaattctgcctctcaaaaatagatgatatataaaaaatattatagcttgtgtaataggaaatcaacacccctcaataagaatttctttaaaatgaccttggtcatttattactttaaagagatcacttaaattttctttcttttttatttgagtaaatacccccatcctaaaccctactgtgtgactgtcaggtgtgagggaacaggcaaggttcttgcagttggctaaggggcacctcattaccagaaaagcaccactgaaaccacaggtctcggaggggagcgttggatgacagtggacctcagtgttacgagttaggattcggaactcagaaataatgctcaggcactaggacttcagggttttccttagcctatgtgtgcccaagtaagagaaacacacatcccccagtacacatacaaacacaaattattgttttaagtttttaaggccagtgtgtccaatcttttggcttccctgggccacataggaagaagaataattgtcttgggccacacatataatacactagcaccaaaaatagctgatgaactaaaaaaaaaaaaaaaatctcataagagagtttacaaatttgtgttgggccacattcaaagctatcctgggctgcatacggtgccgtgggttgaacaagcttggtttaaggtatcataggtaaattataaaatgaagatcgacacagaataactaaagtcttatgccatatccaaagttgagttaatttcactaacggagaaaatcctaattgatttcatcccctttttaatctcaagcatatatcctttgagctgaccggaattctttttataaaaaggtaagaactaatagtatgctccctcctaaaataacagcgattagcataaagctgaattaggttcaggtttctctgtctaaaggagagttagggtcaagtttgtatttgtactcttaaaaaccaagggtaaactttactgctatttaaaactatctactaagattatctttaagggtataaatattaattaattaagaatatattaggaacactgctattttaagttctaagtacatggatattttgtctaagtgatagaaattcaaaattttaataaacttaaaatatataaaataaattatatatagggtccaaaatactgtcaaaaccttgactttagaaaatacaggagtcagagtttatatttagctgcattgtgaaaatgcaatccagaaaaatggttttaagagagagtgaaagagttgagctcacactgaacacttaacttgagctagctattgtcatggttagtgctcaaaccttcagtcccttcacttaacaggcatttagttggtgtttattaaatacagaagaaaaaatatagttggatatgatgcttccttttcctaccttgataagaatatctttgggtatttatgatccttaattccctgttcaaatacaaatttagctacactccaaatatctgctatgtggtaccctttcattgttgtttgttcccttatttccatttagatcttaacattgactcagtgatttgaatgtccacgtgtaacagatttttagagttatatttttgctattgatagttaaatttcttaatgtcctaaaacacgaccagttgttgatatcctccagttgccgagtgactctctcctgatgtcgtgggctcactggtggtacgaatcggacgcgtccttcctaagcttgtactgcaggagccctcaactccacagagagctgtgttactctctctcccaccatggtgttaaatttatccacatattttgttaattctgacaatgtttccttagtacattttgaatccgtgttactaagatcataccattttaaactgctttatcttcctgcgttactaaacctttctaatcctcaaaacctcaaaagtctccttttcctgggatgctgaacatatttttcctcaaaacctcgcatgtctccttttttagtaatgtttccaccctctcctgaaaatctattttatgtgcaattaaaatggtatcaacagcattcttgagttaatacttgcctggattattactttccattcttttactttcgatgtttttctgctcacatgttttaggtatgtcttttgtaacctgcataaagccagattctgttcctttaacccagtctaagagtcattgtctttcacatttcagttagtgcatttccatttcttttcatttctgttacatgaggttttacttgtgccatttttgtgtgcactacttaagttgtcccattttcctatatttcaccccctctctttttttttcatctctcaatttggcattttgtatttcagttctatcccttgaatggttatactagacaatgtaggttcacctctaactttgagggtttaatgttgacaatgactagactgaccaagtgactggtccaggaattgcttcccaggaggtcccaagcctgaggttccaataagggcggggaagataatgaccttggcacagggaccatgacctttgaggacatgactggctgtctctcctggagaaggggcttcctaccaggcccagaggagcgtggtccatgcggagcactgaagacctttgaactcgagccctcgctgggacttgaggccactcccacctccccccaatcaccgtggccacacagctggagttgatgagaagccagggtactgaacagcaaggactcgaatccagccaagacagggaggcccagctctgaacctataaacacatggtgttcggaaaggcctggagaagcagcagccattatttactgccagaaaattcacgaggcaagtcccatatgtgttaggagtgtgaggaaccacacacgtcctacaagtgctgcaatgacaagaaagcatccaaaattccccccatttggcaccaggatctcctatgcaaagaaaggtcttttcagtgcagggaagatgaggaaacctggagccaaagctgtcgcctccttcagaattccaaagtccacactgcagaagggatttgttggggaagccaggctgagaaagttcccactcactcagcacggagaattcacacccaggagaggccgtctatgcgagattcttcagccacgctcaggccttaagcatcccgaatgctcacactggagagatgcccggtgagtgtaatgtgtgaagaagcttcatttgtcacccggaacttcacaggctaacgggcctcatgagcaaagccagcgtgggggactttccgccgcaggtacaccctcgggagtgcacatcagagatggtcttagggctgctgtgcacgcgcctccgcatcctcgttcaggaacaatgtgttcctgcctgagaggcgagcaggagcgtggcctttgtgagaaaggcttcggtcatgatgcaaccccatgtccagagcacccatgccaagggccacagagttgtgaggccttcgggggcgatgatggactttctgaccttccctggaacccagggtgagttgtcacccccagggctgatgggaagaagccttccttcctctccatcctggtggggcagctgccgcccccacatgatcaaagaacgcagcctctagtgtcacccacactaccctggagcaaatccagactgtcctgtgcacagaactggcctaatctggacaaggggacccaaggggtgtcagctggaagcttctgggcaaggcttccttgtcccatggattttaaagtctctatgtgacagctgtgatggcttcaaacagcctatgagtccccttatttgtggactgtggtatccaaagtgggcagaagttgccctagaacaaatcccccaaagataccaggaatgactgtgttattagatgagatcgggcacgttcagggtggtatggccgtagacaggaatgactgtattatcaaactctatcctccatgttttttaagttctcttttattttttaaatctattatgttctggctgcatttaggataatttttttcaggtcaaatttcagatctaagttctattttctctttttacctatgtcttatctgctgttcagcccatttagtaaactttgtgtcaattattataatttatatataattctagaatttcaggtgtgtgtgtgcttgtttaatttgactggatatttccaatcgttttgttttgtttttttaatcttttattttttaaacatattaagcatccttatactctatccttgatgatttcaatttctatgttctttactgttttgaattctgctcactcttattcaccatggcttgtttccacatatatgttgtgatttttctgattgttaatttatgttccttgaaacactgagaaaattatttcaggactcctttgaaagtacagggctcctagaggatttgggctactctcagcccagtacccaggactacaactcatgactgactacattaaacaacattctagacccaggactttctgtgccgcacaggaagagtgaatattggccccaaactcaggtttgagttatagatataactctaacattatacacataatgttgtatatatgtataccatatacatacatagaatgttgaccctaaaaacttgtaagcataaacccatcggtttgtacttacaagtttataggggcaagattctatgtatgtatatatgtataacacatatgtatatatggaaacatagatgtatatataattatattattagatgcaattatatctacatattatgtatgctataatatatacatattacatttgtatacatgtaaacgtatgtaattacacttaagaattctgccctatgaaatacgcactctaatttcatcctggtaggaaactggcaagactgtgtgatacctcaaaaatctgtgagtgacatacaagtcattatctttcttcaggatttggatgaataaaaatctgttcgtagtccctagccctaggctggtggagagtgactgtttattgttgcccactgccatcctggtatccttccgatcagccagcagattggcaagagaaagctcctctcatgattctcgctcaaacgctgtacctgttgctgttgacagactctgttcctgagagaaggtattaactgccagctggctctgacagtttgggaactaaggctgacatttgtgctggcagcataacagtatttacaactcaggaaatgtatacagttagattacgacggagccagcgagttttgaggttaaaaaaatacaacaatatacatgtgaagcatgaccataataacaaaattaacttaaaaataaattcagagcttaggggttctttcaggaaatatctgcggtctatgaaacatatggcatatatgtgcaaagagagaaaggattacaaagaacagaggatggtaattcaattacatcgccggccacccatactatattttgtaatagtccactatgtcagaaaattactaaagaaaggtagaagtagataaagcagaaaaaaaaatcaattttgaatgatggggaatataaatataaaatatcactggagcaggagagaaggtgaatctcatgcttctgtaatttttcttttggaggctctgcactggctctccttttctcacctctccttttccttctatggatataactttgcaatgagtttaaattggcacatttccacacggtccccccaaatgattaagtcactaggaaagtgaccctgaaaggcaggggcacaggttggaattttggtgaatgtaattaacctatttaaatatcataacacttttggcaaacattattagatggaagaacagtcagttgacattttgtctctaatttcctggcaaacagtgaagatgtcatcattttcttgcaataagaggaatgaatgtgaccaggtacttactgcactagtcccagggcagtgtggggattggcattcaccactcatccggtttggaattaaaacatcatcccagcaagatggaccctttgggaaaaaacaacaatatatgcttatatgagttataatagaaatgtactccttaagacatgtttccacttatgttataaaataatagtgaaattagtgtgtagtccaatgattttcaaagtgtggtctgcagactctgggggtccccgtgaccctttcaagggatgtgctaggtcaaaactatgttcatcaacatacaaagacgatatttgacattttgctccaaacctgttcgttttccacttatagcctccccctacggctgaggttaaatgcaccttactagaaaggccatccctgactttgctccacttctgtgtctgccctttcaggcttcctttgcttcataataattattactaccatccccacccaaccccaccatgcagtggcccagcacagagcaagggctgtctgtccctagtcaccacagctacacaaaagccaacttggtctgctctgttccctgaggcatcccagcacctagaggagggcctggcatcgagggggtgcgcagcaagcttccctaggcatcaaagaaataaaaattcaataaaagcaacacttcttttaaattagagaagatcatttaaaatgaaatatcagtgtcaattattgcattcctcttggaaagcaaaccagtaaaaagcatcacaagcattcaactggttcataactttttgactaaattttaagaaatcgggctgtgcacggtggctcattcctataatcccagcactttgggaggttgaagggggcggatcacctgaggtcaggagttcaagaccagtctgactaacatggcgaaaccctgtctgtactaaaaatacaaaaattagctgggtgtggtggcacgcgcctgtaatcacaactactcaggaggccaaggtaggagaatcgcttgaatgcaggaggcagaggtggcagtgagccgagattgtgccactgcactccagtctgggtgacatagcaagactccatctcaaaaaacaaacaaataaagaaacaaaaaatcaaaagcaaaaggcagataggggagagggcacaggggatcaggagcagcaaatttccagatcctcaaatcttctaaacagaaagttcagaccatctacttggaaacaaaaatcaaaatagaatgtttaacttgcagcaataccttcaatttcaacctaaaattctgtgcctgacctaattatcaattaaatgggagaatgggaaaaagtggcttggggagatgcaagttggaaagttggcttgtatgtctgtgagggctcagggttcaggaaatgatcagatgcctgaggaaagccccaggtggcagcctggacctcctcaccgtgggtggagcagtgaggtggccacgggaggggcggagtaagaggtgggttgtctccccagctgtgacacagaaaggaggaggagggagggtggcatcaagggctggaggggattgacagagcttccaggagacgtggtatgaggccactgcccagtgcaaggcagaaggttaggactcaggggcagaggctgtggtgattttactaccgacgacgtttggacccagctagtgtttaagttgtaggagctaaatcggtcatcacaaggcccatctctgcttcaggaaccagtgtagagccgccctggcactttgtagcagatgctgaggaaaatgccgtgggaggtgggcaggggttcacagccacccctgccagtctgcaggagtgctccctccctccctcctttaccattacatgtgtgcacacacacatgcatgccacacactcacatatacatgcacataccacacacactcaggcatgcacgcacacaggcatgcacgcacacagcatgccacacaccacacatgcataaacacaccacatacatacacgtgcacacacatcccacacacctcacacaccccacacacatatacccacatgcatgcacgcacaccaagacacaccacacacgcacgcacaccaaaacacaccacacatgcataaacacaccacatatgtacatgtgcacatgtatccctcacaccccacacgcctaacacaccccacacacatacatccaaacacatacatgcacaccaagacacaccacacatgcataaacacaccacgcacacacgcacacacacacaataccacacagcacacaggcatacacatactacatacactcacacactcatgcatgcacacacgcactattctagagaaaagtcggggacgcagagcagttctccaggcctgagccgtacctgaaagagactgagccttttgacggaggctctttaccccagacttcaaaaggagctgcatctgggatccaccgatcattaatccaaaggccaccgcttaatatggaggtaaatttgcagaagagttctagcaggactgaagctgcgatggtttgaaaagcctgctttcaagcttggcccttggctggcatctgggaatgtgaattttggaagcgtccacatcattcccttactgctacgggtggtgtgcagagcctgaactgtctgcacaaaccatggctatgcacaacatcttctcaccctcggcaaggctggaattttgataagccccaggcagaggtgtctgcatgaccagttcccactaaaatcgctgggcactgactctccattgagcttcctggcagacaacacttcacacgcgttgtcacaactgagtgcctctcgagtgaccactgggggaggactcagagccttgcctgcggtttcctctaaactcctccccctgggccttttcccctcgcttcatatccttttgttgtagtgaatcttagctatgtgtgtgacaggacagcaagtcctgcaggctctcctggtgaatcactgaatctggaggggggaggtggtcttgggggcccaggacatgacgacataggattggtgatcaaggcaatgttctcccaggcacataggagggtcggggctcatcattaatatcacaccagtcacaaagaacaagccgtttcattttctttgcacatcccactgtgttcacgataatggaagcacttatgtgattttcaactttagagtaacactgttaaaactgaacagaggatgttaattatgattatgtaaccaaatatatatgttattcagcttggacaatataaaagcaaaaacagaaatgtgaggacttggaaggcagaagtgaggctggagagaaaacagaaaagtgctgatgaattccctgacctgccaagctgtttttattagaaggttgtctgcacctttgatttttaaacatgagcatatattcactcgataaaagttacaaatgtatagaaataaaagagaggaaaagaaatgatacctacgaccttgatcacgttcatcagcctcatttttctggcttaaagtgagaaattcagtggagataaatgtggctagaatgcagtctgctacaatgaatacactttttaacgtgaggacctttcttactcctatacaaaaactttgaactatagttgctttagccatgcaacttctggaacactgtgtacgacgattaggcaatttaggttttatattttctaaaatatgacaggagcaaagttaaacgtgctttgtaatggcatagattcactgggacatttgtttctattttctggatagtcataacattcatactaatagtgtgagtagtgtggataaattagcatgtctattttattatattgaattcccatattcaacagaggattttaattatgattattaaatatatatgtaatgtacaaattacatggcaaattgcaaatcctttgaggggaacccagagggcacatcttgcccctttgtttgttttaatgtctgtttctctgtaggttgtgatttgttctacctttacggacactacaaatcagatttctctcttttttagacaattaggaaaactttagagtcaaatttgtggaccagctcttgcaattttacataaatcataatacacacttcgtttaccaaaattacccttggcttcatattactttcctttgatccctttcctcatctaatttaatttttcctggttttcatctgcatgtatccctgcaaggttgtcacatcattctgaaacgagtcaggggataattaggtaattgtcgggccttgtgatgtaacctgactgacagctctaacaggagccgtgctccctgggatggtaggtcatctcgcctccagggacaaggtgatctctggccagatgcctgtgccaagctctggctctcatactgtggctggtggcaattcccagtgaaccacactgtgcttgaggcaccgaaaagtccctgcgtttaaaagaaatccatttcgctgtggttaaccattaactaaatgggacaacattgcttctcttctctggaagttttttctgactgactcatgacacatgcaatggtcaataacacacctacgtggcaacagccaagaaggagcactaataggccgggcatggtggctcatgcctggaatcccagcactttgggtggctgaggaggatggatcacctaaggtcaggagttcaagaccaccctggccaacatggtgaaaccttgtctttaataaaacacaaaaattagctgggcatggtggcgggtgcctgtaatctcagctacttgggaggctgagggaggagaatcgcttgagccagggaggcagagattgcagtgggccgagatcacaccactgcactccagcctgggcgacagagtgagactctgcctcaacaagaaaaaaaaaaaaaaaaaaaagaagtagcaccaataattaaatgcaggaattagggcccagttatattttgcttcacagagtaagacttcttacctcaaagtctagaattcagtgagacttttctgtgcatatcacagatgtttattttttcatatttaaatttttactgccctaatagcaactaaaatatttatggaacaattcccgtaattgccacatcaggtactatgttatctgacaaattcgtgttctacagagacattatagaaaactcattcacacattcttcttgatttcaaaccataacacaatggtgtaagtagtaaaactgaatggaattcttttgaatctgggactttaacacagtaaaatagatgttagtttatgcagctgctcacactaatagtgtgaatgctatggctatcctgaaagcagaaacaactgtccaagtgaatttatacccttacaaagcagatttaactgtgctcctgtcaaattttggaaaacataaaactttaattgcctaatcattgaacacagtgttttaagagttgcatggccaaaacaattatagttaatagtttttaaatagtagcaagaaaggtcttcagattaaaaaggactgcaaaaatgcatggcagtagaagggagctatggatgataatacgtcaattagagaagcaaaaccactatttcatccctcaaatctaccgaattagagaaagatatctgaataaaatgtcacatagtctaataggaaaaatttggctggtttttagagaacgttctctttttttttgcctagtaatgacgataaccaagaaaaatatataaattattttagcaacactagcagggtgaggaaaccatgggctgctggccaaatcccaccttatacagactctgtgctaagaaatgttttcatgtttgttaatagttgaaaagcacaaaaagaagaatgtttcgtgacacatgaaaactatgagaaatttaaaattcattgtccataaagttttattggcatatagccacataaagcatggttgcttgtatgctacaatgagctgttgcaacacagacctcatgaaccacacagcctatcacgtttactgtcgggccctttatagaaaaaacttgccaacccctgatctacagcaaattaaattttccaaactcatactgaaaagtactcttttatttttaatattgtggcagcactttggctaacatataatcgcatatgtttgtatgagtaggtatgtcctgggtctcaagtgagaaattacaatgaaaaccttagtgctgttgacctgagaattccgagaagacggtgatagagaagcagcaattgaatcctgggattcatcaaattgtttgcatcagtaagtggaaaatgacaactagagatggcatttgaggactggtcctgactaatgttactgtctatagaaaagcgtgaagcaaatattacctaaacacgtctatatgatgcatgtaaatcagaaatacagaaaaatgaccccacagagggaaagcattgataaaatctgtaacatgtgggttttaaaatttattttcaaaagttctagaactcataatctgaaagccattttggctatgtctttcaatgcccagaaaagtggaaaattgaagtatgtaactgactatttcatatccaaatattattcagacacagtccagactgacaaaacaaaataactatttttcttgagttatctaaataaatgctataatctgctcatcatatgtgagtatatgcattgatgcttaaaataaattgctaattctattttccaaaatgttaatagaaaaccatggcatttacagtttttgaaaaatgttatttaatagtaattttacttaaactatacttaccctattatctcatcttgtcatcgaatatgaaggatttcaaatattctcttgaataatccacaaacatttaagccacataattaagtgtcagggactaaaataattttgtaaatcatactaaggacataatacaacaacagcaaaactatcttgaaaaagctgtacccagaagcttgagtcctcccttgatgtttttctatctgtgtctgcaacaaaatgatacaaagaaggagctttgaagttcacaaacctgttgtatttcatttctaccaatgactagctatatgttcccgagctagttgcatggacccattccaaacttagtactcttcatctgaaaagtaaggaattaaatacctacttcacagagtgtgcatgaagattaaatgaaacaacacaaatacaaacaacactgtgcaaaggcaacacaacaaacgcctttacacagttgctggcacatagagagttaaaaaaatggcaactgttacaagtattatttcttatttctcaaaatagaactgcctgaagagggttatttttggtttagtaaaaactgagcagtaagaagccctttccaagggacctggacccacggcccagtgggtttctgaatttatcctttttctcaatttccctattatccagccctccccaggatcatgtcactttctacagcatgctgtttataactcttctaaagcatgtatcgccctctgtcatatagtagacactgacactgttctgagcatccatcttccttcatttgatttaaagatcctacactgtcacaaagccaagcacagtgccgtggttagagcagcagcataataaatgcaatcattaaatagtaaccaggaaaaagaacgaaaaaaattcgttaaaccaaaatattcatccacttaccaagtatttattgttgctcttaaaccctgagactgcagttataaaaaagggagaataatcgcttttcttgtagactttctatagtagctacaaaaaaatggtattacaaatgaaccaatcacatccattaaaatgagtaagatttttgaaaatgcccatgtaaaagacaggcaagttggaagacaactggaatatacacactgttggtgcaaatggaaaatagtatagtcactgctgaaatctactaggcattctttttttaaagtaaacataaaagtaacatatgactcagttattctactcttaggtagtcatgtgagataaatgaaaatatatccacacagaatgttgcaggcaagtgctcctaacaattttattcatagcaaatgtaaactggagggcacccacatatctatgaaatatttcatctgactggatagacaagatgtagtatgactattcagtggatgaccactcaagaataagcagtgtcctgttacctataaatgcaacaacattaacaattctcaaaatcagcctgagtgaaagaagccaaacatggaatatgtggcatgattccatgtatatgaaatgcagaggtcgcttggggctgggagcacagagtgggaacaagccacataaacacataagggttattttgggggttatgggctgaactgcatcccctcaaaatttatgtttaagtactaacccccagttcctcagaatgtgaatgcatttggagataggtcttgacagaggaaattaagttaaaatgaggtcattagggtgagtcccaatccaatatgactgatgtccttaaaagcagacgaaaggccatgtgaaaatatggggagaaggtggccatctgcaagccaaggacaggggccttggaaaacaccaagcctgctgacacacgttgatctcgacttctagctgccagaaatgtgagaaaatacatttctattgtttacgctttccagtctggggtattttgtcatggcagtcctagcagacaaatatagagggtatggaaatgttctttatcatgactgtgctggtggctttacgttgttatgtacttgtcagaactcctcaaattgtacccttcaaatagagaaagtctatttacacaaattattctcaataaagtgggtaaggaaaacaatgaactgagcaattgacaaggaaactcaataagagacagaggctctctgtagcaaatgttgcttgaaaaactgaatataaatatctcactcaatacagaaagcaaatgggaacttctttataaccttggaacaggtagaacttccttcttgtaaggacacagaaggctctaatcccacataaaggaatgtataaattgaatttcaatgaacattagagctcatcaaaaacactaaaatatgactatgcaagccacagacttgggaaaatattagtaatacatataattgtaaaataagtaatctcagagcttataaagagctaatataaaggacacattaataatacagacataaacacaccagttaaatataagcaaaaaccttgaacaggctattcacaaaacaagacgtataagtggccaataattatataaaacgatggtcaacatcattaataacagggaaaatacaagttaaaatcacaagatacaatttcacttgatttcacattttagccactatgataatactaaatgtcggtgaggataaagattaacaaacgctctcatatatcattggtggaaatataaaacaaccactttgaaaacggttttggaatttctttctttttttttttgatacagagtttcactcggtcgctcaggctggagtgcagtggtgcgatctccgctcactgcaaactctgcctcccaggttcaagtgatactcctgcttcagccttccaagtagctaggattacaggcatttgccaccacacccggctaatttttgaatttttagtagagacagagtctcaccatgttggccaggctggtctgcaactcctgacctcaaaagatccgcctgccttggcctcccgtagttccgggattacaggcaagagccgcagcgcgcagccctggaatttcttattacgttaaacatatagttaaactatgactcagcactttcactccaaggtgttggtccaagaaaaatgaaaatacacacacacacacagagcaacatagactcgtacaagcatctaacatcacagccttactcatgttaacccaaacctggaaacaagcaaatgtcctttgacagtgactagaataaaccatggggtctcacatagtggcagactcagaaatgaaaagagagctactgagtcacacaaccacatggatgagtctcgaaacaaaacaccatatttaccaaaaggagctggccatagaaaagtatgtattatatgattccatttatatgaaatccagcaaaaagaaagattaatctatggtgataaaaatcagaagaggttatctttggaatggggaggtactgactagaaaaagagataagggaactttctggaaatgttctacattttggttggggtagtagttacatgagtgtatgtaactgtcgaagcttttagaattgacacagtgcattttgtagagtgtaaattgttctataatttaaaataatagactgaatctcctatcccatccttcagtgatttcctcttagcttttggaaacaatagtctgtgatttctgttataagataatccaagtcactgccaatcaacacaaaagactaaccagtcctagggctttgaactggttactaaccttcatcatcaggctacaaaactcttaaagtcaaggactgtgtcctacatatatctatgtgctttgctgtgaatagataaatgttttacctaaacatagtgaatacacaagaataattaagtcagactttaattttctcatctgtaaaataatgaaaactgaaaaatctgtattttcaaagttacattttcttttaagcagggtactttcattacatgaaattgtctatagtaaccaaatacataaaacaaataaagctgacccaatgtggttgaagaagaaggacgagtccccagaattctcattaatggcctcttttctctttgtcccatgtgatgcccttaagggccctccccacagaaaacaatttgaaatcctaaaagtctcttacaataatacaccatgggtatgctcagagaaaagtccacagtggtaaagaatctggcagaatatggttgaatcaaattgtattagggttcttcagaggggcagaactaataggatctatgtgtatatgaaagggagtttattagggagaattggctcacatgatcacaagatgaagtccaaggataggccgtgtgcaggctgaggaagaaagaagccagtagtggcacagtccgagtccaaaagcctcaaaagtagggaagccaacagtgcaggcttcagtctgtggctgaagacctgagagcccctggcaaaccactggtgtaaatctaagagtccaaaggctgaagaacctggagtctgatgtccaagggcaggaggaatgaaaacatccagcatgaaagaaagatggaagccagaagactcagcaagccagtttatcccaatttctttggtttgctttgttctagccatgggggcagcagactggatggtgcctacccacattgaggatgggtcttcttcacccagtccactgactcgaatttcaatatcctctggcaacaccctcacagacatgccttgaaacaattcttttctttttcttttttttttttggtcaatttttaaaaaaattatatgttaagttctagggtacacgtgcacaacgtgcaggtttgttacatatgcatacaggtgacatgttggtttgcttcccccatcaactcgtcatttacatcaggtatttctcctaatgccatccctcccccagccctccaccccatggcaggccccagtatgtgatgttccctgccctgtgtccaagtcatctcattgttcaattcccacctatgagtgagaacacgcggtgtttgattttctgtccttgtgatattttgctgagaatgatggtttccagcttcgtccatgtctctgcaaaggacatgaacacatccttttttatgactgcatagaattccatggtgtatatgtgccacattttcttattccagtctatcattgatggacatttgggttggttccaagtctttgctattgtgaatagtgctgtaataaacatacgtgtgcatgtgtcttgatagtagcatgatttataatcctttgggtatatacccagtaatgggattgctgggtcaaatggtgtttctagttctagatccttgaggaatcgccacactgtcttccacaatggttgaactaatttacactcccactaacactgtaaaagtgttcctatttctccacatcctctccagcatctgttgtgcctggaaacaattctttaccagctatctaggcatccttcaatcgaatcaagtcaacacctaatactaaccatcacacaaatccttaaaaggccatcctttattttctctctctctcttttaaggaaacacatattagctgtggctaacatatatgttcattagaacacatatattatgctctttgctatggtctagatatgtcccctaaaattcatgtgttggaaactgagttcctaatgcaacagtgttaggaggggggcctaatggaaagcgtttaagtcacaagggctccacctgcatgaatggatcaatacccctaagaaaggagcttgcaggagtgggttctctttctactgctcttcgaccatgtgaggacacactgttcctccctactggagcacatagaattcaaggtgctatcttagaagcaaagagaccaggccttgacctgctggggccttgatccagaattgtgagaaatagatttctgttctttttaagttactcagacccaggaattctaatatagcagcacaaaaagaactaagacattcttaaaatacttaattgaatcactgatacagatcacatgacattatccaggtgaaacagacatttgtctttatgttgtggcagaagctttcagttgtctcctctcttcttttatggtaacagaatttctgatttatagctgagcatatgactccctggaaaaatgactctacctcccagcttcccttgcctgactggccatgtaagtgatgaccaacgggatataacagaggtgtcctgtggaaacttctacttgtccttttcttcatccatttttttttctctcctgtttgtaatatacatagtgcatcttgaaccacaagttcaaggttatacaacgtagagcaacaatatagaaagagtctgggttcctgtcatcatgaagtgccacagcagccttgaaccacctatctaaacttttacatgagagaaaaactgaactctcacattacataagtcactgttactttgaatttttaagatattcactgtcaaatccaatggtcattattattacaattaaattaactttgttttgatagaaaaatcaatggagcacacaaaacagtagcaatattctatgatctaagaaaccaacaagaattttcttttacatacatgaggatgttgacataggaagataaataagtcttttggaagacaaaagtaaaatattacttataatacatcagggaataagaccttatttatgagttcatgagtttttacaattacagaagttgaccataaaacccaaacttttaaaaaagcattgatcattttgatgaaaatctttaccaaatgtgttctatagtccatccttatttcagcagattacacgcgacatgcacatgatgacttagctttctaaaaagagcaatggtgtaacgaatatatgccacttgccagaagccatagttaataccatatgtacacctcatccctagtgacctataaacaaaacaaggtgggcagtgccacagccttttttacagatggagagactgaggcttggagatgctgagatatgtccaaggctacaagtttacaaagtaacaaagtccatttatcataaaagtatttgttgttttgttcacttttcagacacagttttaaaaaatacatgtcaaataaataagcattttttatttactgttttaccatgaactacagtgaaatccttgctaactgtatctctttccttcagaggccgatgtcggacagatgtcaccgtcatgtcaggatggtggacattttcctatctggtgggtaggaaatcagtaactacatttactaattatgaaaacaccaccaagttaagattttgttacaagaaatgtgtacggacatacatttttagaatatatgtcaatatctttatactcctttggcctctttgctgataacctgcttttcatttagttatttcctgagttttgtaggtgtttttcttttaaagtctttattatcgacaggtttttccaggtacattacttcatttatctcagaaatcatatgagacattatacttggcatttcttttctattgctgtgtaacaaataaccacaattttgttgcttaaaacaacatgcttttatgatctcacagtttctgtggggcaggcctggtgtgacttctgctcagagtcccatgaggcccagtcaagatgtcggctgggctgctctcttccctggagactccattacagcaaaactagcttctaagctctctcaggctgttggcagaattaacttccttgcagctgtcattacaagggcctcggctttctgctgcctgttggctggaggcctcctgccgttccttgccatgtgagcttcctcaccttggcagttcacttcatcaagtcaacaaggagagggtctgctccagtctccactgaatccatcataagtaatatcgtcaggggaagtcttagataacataattggcacggtcagggaaatcaaatcacttttgctgtattttcttggttagagaaagcaatttcacatgagcatgtacaggaggtggtgggaggtcactgggccgggggggtgggggtcatcttcatgtctgtccatgccccgtttaacaaattaggagaaggagctttcataaaattaaagtttcagaaatggtaactcaatatataacattagttgtcaagtactcaggctatttttcaaaaatataaacacatgtttcagtttaggtacgtgaatatttgaacacttccttggagtcctccttttaaaatttcaaataagtcattttatagcttgggagatgatatggtttggctgtgtccccacccaaatctcaacttgaattgtatctcccagaattcccacgtgttgtgggaggcacctagaaggaggtaatagaatcatgggggctggtctctctcgtgctattctcatgatagtgaataagtctcatgaaatctgatgggtgtatcaggggtttccacttttgcttcttcctcattttctcttgccaccaccatgtaagaagtgcctttcacctcacgccatgattctgaggcctccccagtcatgtggaactgtaagtccaattaaacctctttttgttcccagactcaggtatgtctttatcagcagtgtgaaaattgactaatacaggagatattaagaaataaataccagatgtaaccagaaactgagtttctgtttattctggcatgttaaactttacaagattagaatatgttacacaaacagaaacatgtcttgctttaatgagtgtatatattcctttctaacttgaatttattccctatgatttcttagagcaagaacgtattatagaagcagttaactaaaaggctcactacggttaattctgcagaaagaaatagaagtttacagaagttaattctgcagaaagaaatagaaaggattaattgttcctaagtaagccaagttatctctacaaattgtttaaaacaaatattagaaggaaaacaataattaagagaagatcttaagaagacacctaatctagttcttattaatatttttcatttctgattttgatattatatgaataatgaaaaatccctcatttgaaaaaactttatatggtatacaggacgcaagagaggcaaaaatgatttttgtaaattccagccagtctccaagagactatgatcataataaaagcaatggcaatggcatcaccttgcattagtataaaacaggtttgtctacaaatcgctttcacatgtcccaagccaaccttgatttccagtgaaaatctgttaatgctgtgttctatagagctctgagccacacatggattacttggtcatgtgttgataatttgttcatgtgtaactgcagaactgtttcccaacaaaaccctggccccaagcccaagtattcactgggttctcacatgtaactacttgggtatatcttgatgattacatcatgcattttcataagagtatccattttatctaacgatttgttaatcatcaaaacaaggatcttccctcattttgtaatagaacaactgaagtccatgcttttcttggaaaatatagtcatattttagtaaaagtgtgatcacaaggctgggcagagttagctgggtaagtttgactctgctctatgtggggtcagctcggatggttcagtgggactgaatggtttcttttcaacgtggctcttttgcatggccgagtggatgctgaatataagctgaggtcagtgggctggtgttcttagttcttcttaacaagggggtgccctagagcagtggcccccaatctttttagttgtctgtcattgtcaacatgcacaggtttgacggaagacagtttttccagggacccagtgggatggtttcaggataaaactgttccacctcacatcatcaagcattagattctcataaggagcgtgcaacctagatcccccacatgcacagttcacaatagagttcttgctcctaggagaatctcatgctgccactgatttgacaggaggtggagctcgggctgtaatgctcgctcgcctactgcttatctcctgctgagtggcctggttcctaacaggccacccctgctggcccagggcttgggcaccgctgccctagggcacagtaggtgctttctaaaggtgactaccctaagagagaggaagtagaaacttccagtttcttaaggcctgagcctggaaatgggcagagtgtcatttctaacatgttctattagtgaagcagtcacagagctcagatgtgctaaaagaggttggtatttaaagaaaataattctaacagcacatcgtgtcacgttttcatctggcatttcactggacggtattcgacatttgcagtttaatattttgtgcccttgagcactgccacccttaggaaggtgtttggtgctgtccatgccctcatctgtgaaatgggggcagagacagcaccaaacaccttcctagtagatcagctcttcttagcctcatctcttgtcactctattcccagcattttccccactttctgacaatgtggcccattttgattttcctttattgttattcaaagtaccttagtaatatatgctttattaaaggcctttagataatttaaatatcatgaaacagtaatgtatctcatggaatatagtttacagacacctaaacaatacaacagcactaattcttctggttctccaaaagttccaataggatccctcttaaatttccatcaggtcatgggcatgggcagacagtatctgtgaacttatcagtggattccaattattttactgaatttaattttttttttttttttgagatggagtctcgagctgtagcccaggctggagtgcagtactgcgatcctggcaaactgcaacctctgcctgccgggttcaagtgattcttgtgccacagcctccgagtagctgggattacaggcacatggcaccacacccactaatttttgtattttttcagtagagatggggttttaccatgttggccagcctggtctcgaactcctgacttcaagtgatccacctatgtcggcctcccaaagtactaggattacaggcttgagccaccgcacccaacctattttacttaattactctagtttctcaaagacactcttcatttctcctagtgtttggaatcactaccaaacactatcataaagttctgaaaaagcattcattgttgctaattttaagtcattgattttttaattcctttaacaaataatgagcatctaaaaagtgacacacattttgccagattgtggggatggaatactgaaagagacttttgcacgtcaggaggataaaagtgattacacaggctgggcgcggtggctcacgcctgtaatcccagttgcttgggaggctgaggtaggggaatcacctgaaccagggaggcagaggttgcagtgacccaagatcacgccactgcactccagcccgggtgacagagcgagactccgtccaaaaaaaaatattaaacaggcaattaatactgagactctttgagggtatattggagggatgagagacctcgacttctgagagagctgggttttaagctgagagcagaggaatgagtagcagcagtaggttttgcgggaagaagtagtattctgagcatggagaacagaagaaaattccacaagccctgagcctgattcttggaatatcgatcccaaacaagatgatttctcagatactgacaattaatccataaataatccatttttattcgtgcaatttcctaaatatctccatccataccactagtcttgataacacaattcaattgtaatatacatgtaactgtaatgtacacaagttcctgatttcaaagcaatgaggatgtcaagatgataaacagtggttttgtgctttggtatcagaatgactgggtttcgaatctaatggccactaccagccaagtcaggatgggggtgtttctgaacatcaattttatgatatgtaatgtggaaataacaattgcacgtaacaaacaggactgatagttaaatgagataaagtagttagcaaaataccacacgcatagtgaatattcgataaacgttagtgggtactgctgaataaccacagtagaacaatatcatcatggaaagaactcagtagagaaagactcagaagatctaagttcaggatgcaatttcacttgagtatcacctcatcgatttaacatcctcatgcttcactatcttatctgtaaagtgtgggtacaggccaaaagagctcagggtcaaataagataacaaatgagctaattaatgtgaaaaccattgaagctacagcaaacaggtcacacagatagtagtaaatgaatgaatggagcaaggggtagtcttgaaaccgtctgataggagagagaattgtactcacgcttactcactttataacaaccccaaacctgggaccactttcaagtaaaagtgaacttaaaacacaatgctgcagctgctgttggcctcagcgttaaccagagcaagtgtctattcctgtatttattactcagtactgccaagttaactcaatggctgcctaaacagaacatctcagctggtcttgaaaattttcccaagtactacctctatagctttgggtttttttgttgttgttttttgtgtgtctgttttctgagacagggtctcgctctgtcacccaggcttgagtgcagtggcacgatatggctcactgcagccaaaacctcctgggctcaagcgatcctcccacctcagccccctaagtagctgggactccagacgtgcatcaccacacccggttaatttttatactttttgtagagacaaggtttcgccatgttggccagactggtgtggaactcccgggctcaagcaacctgcctgccttggcctcccaaagtgctgggattacaggcttgatgccctgccctcagccctctacagcttttaaaacataatttggcagataattcacttccaatacaaaaacgtgtttggtatcataaaaagcaagcatttcataatctaatactcaataccataatttacccactctgagaaaattatcacaagaaaaaagtcacatggagaaatgcaaatcaaaatcacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggcgattcctcaaggatctagaactggaaataccatttgacccagccatcccattactgggtatatacccaaaggactataaatcatgctgctataaagacacatgcacacgtatgtttattgccgcattattcacaatagcaaagacttggaaccaacccaaatgtccaacaatgatagactggatgaagaaaatgtggcacatatacaccatggaatactatgcagccataaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtgtggtggggggagggggagggatagcattgggagatatacctaatgctagatgacgagttagtgggtgcagcacaccagcatggcacatgtatacgtatgtaactaacctgcacaatgtgcacatgtaccctaaaacttaaagtatatatataaaaaaaagtcacatttcttaagaataattctcattagtgtaagtgaagtgactcgtcctccacgaaaatgcagctccgctgggttttgacacagtcaatcaccatcattacttaccgagtccctccatgcagggtgtacctatgttaaaccaatgaaatgccaacaacgcgtttcccccttcacaacttccagtcaccaaactattcctgaaccacaagatgccttcagttatattactatgtgttgacagctttgctgtaggtacatcacagggatagcagaattgaaacagcagtgattttttttgttgttccgtttcatagaatttaaacaatggagacaataaagccttacagatctggtgattcacatgaacgcactcttaacggatttaatttaggagaaccatatgattatcttcgtctgttcaagcttcctttactaaaaatagtctggctgttgcatggaggaaagtttgctgtagctcagattagaggcagtttcaggcagcaaaatatgtttctagctgttgagatggtagcactcatttcaattcatggcatgtaaatctatttgaataatatttatcatcatataaagattcatagttacctcagctggctttatgatcttgataattatgactggaactcaactatgcttattaaataagaagtttattagatttctagtgaatgctcagataccatcatcatcatagaaatattattatttagttctcaaaattaagctttatgaataacacatcacattttggtgtgtagtatagtactctaactccccacataaaacttaacttgatcgcctgcatttatttttaagaaagggaaaggtacaaatcacatcggattatggttaaaattataaaaagtccacattgtatttaattttctattgcttctatataatgtactgcccgtgaatatgtatcatcaatctgggctgactatcttgaccactggtcaacaactatcttgaccactccaacaacgttttggagtggtggaggtgagaaaggcatgtatcactgaagtaagaagctggctagataaggacttagcaaggactataaggaaaagtgcttttcaagggtcctaaagggcaacagaacttaggccccccagtgaaacattaaacacgtatgtaacgagcaggcttccaatcatctgagagctaatgatgctaccatgtatttataaggtacatttatccccatcttttcactgaaccgtacacattgtgggcaggggttcctattcttgccccttactgtcctggggtttgtagacatgaaaaaagaaaggcttgcttttttttttttttttttttttaagacagagtctcactctgtcacccaggctggagaacagtggcatgacctcggcttactgcaaccttcatctcctggcttcaagtgattctcctgcctcaacctccctagtagctgggattataggcatgtgcccccacacccagctaatttttgtatttttagtagagatggggtttcaccatgttggccagactggtctcgaactcctgacctcaagtgatcccccagcattggcctcccaaagtgctgggattacaggttgcaagccacctggcccagccaaggaaggccttcttaatccaaaaaaaaccaaataagatttggccaaaagaagagtcactttgtccttggacaagtatgttggcaaagacatacatattttttaatttgttttaacatggtctggtttaatacacattgtatagatgttctagtctataaatttccctctgagccttttcacttcaagatattccgatgcctctttcttgtttcctctcttctatctttcccccgattgtgttataatcaaagtccaatcacctctaaaaatcattcaggcctgtttctttatgatctaatcagagagaagaggaagtcttaattttaggtgaaaactaactaaatttgtagtcatctgggcattcttagcactgatttaaaccagctacagtttattctgaaacgttttaagtttctcacaggtttccgcaagaatttccccaaattattattttatcatttatcctccttttagatcgatgtttttgacttaataaaccaacttttcttaaaatttgctcttgcaatgtacatggatttcatcaaatgaagtggaaaagattgttgctgaagaacaaataagctcttgattataaatcattgactttcttaactttttgacataataatattttcaggggaacaattttcttcccccacatgcctgtcattgctcagagaactgcaactcccatcttcttcactcactcatccacaacgccgtccacacactctctgcatgatgagtgtgtcacttcagtcagagggaagagagtgggcaggctgttgggactgcaaacccgtgctcagattccccagactaccttcaccaggaacgtggcagacatggaggctggtgacccaacatccatttccctcttggttcaaaagatggaaggatacagttcattgaaaattgttcaaatgcacaaataattaccactgtattactgttacctacagcattcaatatagtaacatgttgtccatgtttacagcctcagagcaataggctgacctattctcttgctctgaaagcctaggtgtctggtaggctacagcatctagctgtgtctaaacacatgctatgatgttcgcacaatgacaaaatcacctaacaacacattgttagaacctatcccaccacagttcagcaatgcatgactgcacttctactgccccatgcacgtttgccactttatggctgtttattttgttgatggagaaaaattagtgcaagtaaaatagagggacctggaggaggtctcttataaattgcttgtgattattagctgagtattctttcaaaatagcccatcccaccactcccactactaattttatctattccatgaatgattaatttttaacaaaaatgaaaaatccaggatggtttaggtaaggaaaaaattaagagttttctttaaaatgtttattttttattcatggctgggcgctgtggctcaggtctgtaatcccagaactttgagaggccgaggcgggtggatcacctgagatcagaagttcaagaccagcctggccaatgtggtgaaaccctgtctctactaaaaatacaaaaattagtcagtcatggtgacatttgcctgtaatcccagctaactcagtagggtgaggcaggataatcacttgaactcaggaggcggaggttgcagtgagccaagatcacaccactgcacagcagcctgggcaacagagagagactctctctctaaaaaaaaaaaaaaaaaaaaaattattttttattcacaatactagcatacacctacatttcaactgattatagcatatgggataagttgaaatttgatattccataaacctttgggtcttttatgttaacagctcaaactggcttcattaaaaaaatgtatggtatcagccaacagatcatgggttctcagcatctgaagaaattcaacgttctctcatttttcacggttttaacttctcatgactttagtgcatggatacacttgttcagttgtatcccatggcttctaacatctgactatgcttcttgagatcagtctgaaagctgaggcatgttcatacttgatcttgaaacatgccatattaatacatttattcatagaagtattagtaattgtgatattattcaggaatcaaaaaacaaagggaaacacagagcttgcttgttatcccaaattatgctctggtttaaggaaatctttccccgaaatcatgttacttaattttagctaatttagatgacatttaccattctcttacctaaggccaagaaaacagttatattttaattagaacttagtgtcaaacatttttaagtttgataaaaaagccacttttctgggcaattttgcagggcctcattttgattccctgttacctcaaaatgactaagcaaaggagagctgtattgggtatttatcaagaaaactataaataatgtattgggaataaatgcgtgtgccacaaaccataaacttgtaaaggctttctgttctcctggtgtgaataagatagggacatcacaactcggagccattaaatgaaaagaatagggttactaagcaagattattaatacttaataattaatacttaataattaataaatactttaaaaaagattaggtaagatttaatttaatagatcagaccctcctttacagtctgtcttcacacaaaatcacaaagtcttacgtgactcaaatttcttttgaagtcatcagaggttgccattctggaactcataagcggtgacagctgatagcctcacagtcatgaaggaggtagaaaagttaacatgaaattcccaaagctcagcactcgagccttttcagaagctggatggaaatcgctgttcacagctccacagcccctgacagcatcattctatgagaacaaggtcaagtggaaggtgtagcggaacacgaatttgtagtctgagatctcaaggaaatgaagcaatctatttggaaaagcaaggacgatagttgggaaccattagcaacactacagacagaataggcagatactccgttgcccaactcaaaagggaattcatattctccaaatcctgacctctagctagctgttgttcttgtaatttgtaaatcggtgtcctcttttctatacccaaagccagcatcttattttgatacatcatactcccttttggatgactgcagtaacttgtcaactaattttgtgctgtccttctcagttctctcaaatgtattcacatacctgccggaggaatatttccaaagaaaaacaaaaccctgcccatcccctgtttaaacccctctcatggttcccccttatttcaggacagtttatgctccctggtccctaacacagctcagggagtcttttctcatctgcccacttccctccttccccacctctctccacccaccttattgtcaccctctacatagaaatccacaggcacacctataaggaaacatagagttatgcgtgattttgaatcttcctggaaactttctctgcttagaaaatttttttactttctagggtctttcaatcagaaggtctcaggaatgtttaatgagagtaatgcatttacagttagtataatgctgcatttaggttatgtttattggaaaaatgaattctcaactttctcaaatattcctcacctgctctgtgctattgcctactacaagcacatatatcttaaggtccaggttgacacattttgctttcctgctggacattttctggtgactgcatttccctaggattcttccccagcaactgagactgatggaaacaagtttctcagtttcaaatgaagattcagaataatgactatcatcctgtgtgtttattagaacccggtgaatcgagatgatttctaaagagagagtgcaatagaaaaatacagaatttagaagaaaagtacctaagttcaagattcattatttatatatgaaattgtacccttgggcaagtaatttcaattctacaatgctcaggtttgtctaggtgtaaaataagaaatagtatcagctctcgatatcctgtaagattttggtgaggataaaacaaacaaaacacatgaaaagttcttttccgccctaaaacactgtaatgttagttacaggcataagttggagatactgtgggttcagttacagatcactgcaataaagcagatatcacaataaagcaagtcacacaaagctgaggtttctcagtgcacacaaaaagtatgcttgcactatactgtagtttgttaagtatgcaatagtcttatgtctaaaacgagaatggacatgtcttaattaaaaaatacttcattgctaaaaaatgttaactctcatctgaaccttcaagtcataaccttttttgctagtggcaggtcttgcgtcgatgctgatggctgcagactgttcagggtgatggctgctgaaagctggggtggatgtggcaatgtcttaaaataagacaacaatgaagtttgccgcactgatggactcttcatttcataaaagatttctctgtagcatgtcattctgtctgacagcagcagaaccttcaaaactggagtcagtcctctcaaaccctgtggctgcttgatcatctaagtttatttcatgtctgaaatcctgtgttatcatttcaacaatgttcacagcactttcatcaggagtaggtttcatcttaagaaaccactttgttcttccataagaagcaactcctcatccgttcatattttattatgagattgcagaaattgagtcatgtcttcagcctccacttctaattctactgttcttgctattttcacctcatcttcagttacctgctccactgaagtcttgaatcccttaaagtcatccatgagggttagaatcgacttcttccaactcctattaatcttcatattttgacctccactcatgaatcatgaagttcttaatggcatctagaatggtgaatcgtttccagaaagttttcagtttactttccccagatccatcagagaaatgtaatgatctttagtgatctatgagagctatagcatcatgaaatttttttaaaatagtaagtcttgaaagtcaaaattactcattgatccatggactgcagaatttaggtgttgttttagcaggcatgaagactacattcacttccctatacatttccaccagagttcctgggtgaccaggtgcactggcattgagaagtaatattgtgaaaggaatgttttttcccgagcagtgggtctcaacagtgaccttaaaatatccagtaaaccgtgctgtaaacaggtgtgctgtcatctaggctttgttgttccatttatagagcacaggcacagtaaacttagcataatcttaagggacctaggattttcaaaatggtaaatgagtattgtcttcaacttaaagtcacccactgcattacccctaacaagagagtcagcctgttctttgaagcattaaagccaggtattgacttctctctagctaagaaagtcctagatagcatcttgttccaatagacggctgtgtcatctacactgaaaatctgtagtttactgtggccaccttcatcattgaccgtagctaggtcttctacataacttgaggcagcttctccatcagcactcaccctgaacttgaactgtgatggagatggcttctttccttaaacctcatgaatctacctctgccagctgaacaacttttcttgtgcagcttcctcacctctctcagccttcatagaattgaagagggtacaggtctttgatctggtttggctgtgtccccacccaaatctcatcttgaattgtaactcctacaatttccaagtgttgtgggaggaacctggttgggggttgttgaatcatgggggtaggtctttcccatgatattctcttgaaagtgaatgagcctcaaagattggatggttttataaggggaactttccctgcacaagctctcttctcgtcgggcaccatgtgagatgtgccttcaccttctgccatgattatgaggcctccccagccacgtggaactgtaagtgcattcaacctctttcttttttaaattgcctagtctcaggtatatctttatcagcaacgtgagaacagactaatacagccttcctctggattaggtttttggcttaaggaaatgtagctggtttcaacatctgtctggactactaaaatttccttcatatcagcaataaagctgtttttctttctaatcatttttgtctacactggagtagcacttttaatttccttcaaggaattttcctttgcattctccacttagctaaatgttttccacaagaggcctagcatttggtctatattggctttcaacatgccttcctcactgagctcaatcatctctagctttgatttaagtgagagacgtgccattcctcctttcacttgaacacttagagcccatcataggactaattggcccaattttcatgttatgttgtctgaggaaatagggaggcccaaggagagggagagagatgtggggatggttggtcactggagcagtcagaacacacacaatatttaccaatttcatttaccatctcatatgggtgtggttcatggtattctaaaactattataattgtaacactaaagatcactgatcataccctaaaattattagaataaatttcattcttttaaaaaaattattctgttttgtattgctcaggctggatgcagtggcgcgatgtcagctcactgcaacctctgcctcccaggttcaagggattctcctgcctcagcctcccaagtagcttggattacaggtgcctgccaacacgcccacccagttttgggacttttaatagagacggggtttttccatattggccaggctggtctcgaactcctgacctcaggtgatccacccgccatatacttttgaaagacaaagtctgaactattaactgaaaacaaagatccccaatcactctaacagattaataataatgcaaaggtttaaaacattgtgagaatttccaaaatgtgatactgagacatgaagtgggcacatactgttggaaaaatggtgctgctgatagacttgccgctcaataccgggtttccacaaaccttcaatttgtaaaaaatacaataccagagaagggcaatgaagtgacatgcaataaagtgaggtgcgcctgtactgttttcattttcatcaagccaaaccataagaatcttgcacaacatctgtattattagagtagcatgaataatgctttttattgtaattttgtttttacttccaaaaagagaaataatttttttttctgattatgaactaaacaggtcctcctgtctagtaatagaacatcaaatcatcaccatagagattcaacttctctttttaggaattaaaaatagtcacaatccacttatcaattacacagttaataacttgatgccagaaggattttgacaaaacacagtacccttcattctcttttaccttagaaatgatttacatttcaggttaaagaaattctgacactcaactaaaaatacctgcagacagatatctgtaacccatatatgaattgacagcattttaaaaatagaaaagttggtatttcttcatttttcaaagatttaatgttaagaaggaatggttactagaattaatatttttccagggacactaataatttgattataattgaaaattaaaaaataattttagaaagaattgaaatacacatagcattctcataaaaatagaaattataattataatgttgatttagtttttgacagaggtaaaaactattaaatgcattagatacatattattgaaaatatttgaaggggtaggtcatagtttctctttccaaacataaaatataatattaggttggtgcaaaagatttttaccattaaaagcaatagcaaaacctgcgattacttttgcaccaaaccaatgtgtactgtaaagccaaatcctgtaatctctttaaatttgacttaacatttgcgacctacatccactcatgcattgaaaaggcagctccgtggagtcaacatctgtacatgaagcccgtgaagacgctgcctccatgggaccagaacaagttaaagaattcaggttgctggtttctttcaataaagttgtgggaagtaagtttcactatatgtagaacattctgaggaattgtagttttggtatcatttagtattatttggatattaagaacaggacttataggagtcttcaaaaataatcataatacatttatgaatgtaatgaaataattgtgttatactgttgctatagctatgcagattatctgagagatacctgagttatttatgtttctacaaacataagttacactactgctatattcaatgaaagtatacattagtaaattttcctatactctgtgttactaagagtgtactgtagttacaggaactgtggcatctctatagtgtgtatttaaaaaatactcaagcaaacttcagttataaggcaattatgatccaagcaaagttcaattataaaataggtaatgataatatagaaggcacaattaggacaaaatattcctgtctctgtactgtcagatagcctggaattacaatcagtaacctgaacttcatttagtgtgaaggcagagtctccaaaatccaattcaaacaaaaaaggttaaagtgacatgttattccattatcactcattgctatattgatacagactagttgatcagtgtcctaccacaaacacacacacaaagagagagactcactcctcatgcagtgagacagtggaaatagggaaacagatgtcttaagaggaaaaacccaaatgggacatacgagataggctttttaaaaaaccctacataggcctgcacaaagaaatggatgtaattctagacaaatcccaccatgttgtataaatggaggtgaaagataaggaattacccctacccctaaaaacaactgagttgaaattaaaagtatgattatattatggattgtctaacttcacaagtattatcaacttactaatttatattaatgaatagctttcaatctagatatgatttcaaataagcaatacatatttgactattcagttattgaaatgattttcatgcatctactgtgtgttaaactttgtattaaatgttagaaatcaaacacgagtgagattcaggactatattctattattctataatttaatggaggacataaagagcagatatttgacaaagaaatgcataacatactaagggagttcatttaatggcaagaccaattataattttgtttccaacttggtatgaactatgcttaccaactgtgagagaggggagttaagatactattcatgtattctcaaattagtcaattccaagaatttgttgagtgttactcttttcaaatcaggtgggtggttggctcaatcagcgctggcaggttacattcccatcttactgttctcaccaccacccactgcagtgaaaaacacttttatgacagaaatttacctgttttaaaagtacttttgttctcagaactgagagattttattgttaaataaaagtgacaggggaagcaacataaagtatcaaagatggttctgatcaagtcatgtaacagtgcctatgagaaagatttgccattctactctatccatcctattagtccccctaatatttccttcttaaggctttgaaatctccccatagaactccttatgttacttcgagaattttaatagtcatacggcaaataagcagagagcagctcacaattaatgtactaatgcccttttcttttaataaaaattatactctttcattatcctattaacaaatgattctttagggagcatttctttaatgttcacagtgctggcaccctagttggcactcaactatcttaaatttttaatgaattcagaattagtctgggcatctctcaaaacttagagtctctgagtgcatgagtggactctttatgttatcagatttattgttttgaaagcaaagaagactaggaatataagcaaaagaggaaacaagcaggtagtttgagagtgtagaaaactccatggcacacaagcacattgtaaggtaacacctttttcaccaatggagagaaaagagaggaagagatggaggagcaaaacgactcgctgttaccatactagcagtgtcagcactacaaaatacaacatttaaaaatgtgttaagatgtttttctgtatttatcaacagataaacccacagccagcccaaatcaggtactggagattaaaactaaatccctggacaaagattagcatctcaaggagaggctgtacaacattagagaaaaatgtggttgagcaggttgaaaaggacaccttcacagacacatctgggagaatgctagcagctcttcaaatacttctccttagtagcatttatctccatcttaactacatcactgatgcattaattataggacatttttctctctggttagaatgtaagttccttgagagaacagaccttttttgtctgaattccagtgactagtctactgccatgcaggctcacagttcgtatttgtggaatgaaattgctgaagaattaattatacatgaaggaaattcaagcgtaaattgagccattaatacaaatatgaaaatacaaggaaatatgaactttagaaagcaaataatatgccacagaggttcccaattgcatacttcactggactcacttcatttagggacctcattttctaaggtcccccagctgtccagtgctcaggtcatcactgacatgggctcagaaaatacagatacatccccaaggcagagccagtgtttgttttatttttgttttaatgtaagcaccacttacctttttcacctatgggtagactctctcattccatgatattagaaaatgtttcaaatgaaaatgcccctggttgtaatataatgactaaaattacattaagatatcaatataaagagtatcaaaaactttcctaaaaatcagttttaataaaagagttgagaacatgagaatgcccttaaggaaagggtagtagaaagaaaaatcaaatatacatttgaagttcatcaaaatagatttggagttggcacagattagaattttattatttttttaaaaattgggccagaaacgagcacctactttacgctaggcactgtgcttccctatgaaaggaagcatggtttctgcttcaagtgggtgagtggagggcctacaggtgcttagagaataatttctttttttttttttttttttttctgagacggagtctcgctccgtcaccaggctggagtgcagtggcgcgatctcggctcactgcaagctccgcttcccaggttcaagcaattctcctgcctcagcctcctgagtagctgggattacaggcacacgccaccacgcccagctaatttttctatttttagtagagacggggtttcaccatgttggtcaggctggtctcgatctcgtgacctcgtgatccacccgcctcagcctcccaaagtgctgggattacaggcatgagtcactgcgcccggccaataatttctaaacaatagtaatgcaaatagagtatgcacagcgtggacattccagcttcctaaacgcaggagcactaacgctcctctggcttgagagagagtcatcagaatgcaaagatagaaagagatagacaaattaggggatgcaagggatgcaatccagtacaggctccaatttctaaccctgtcccacatcaatgaggacctttagagagggcacaatattatccacagtctcataattcaacagggaattgggcaaagaaacaaaaatagtgactatggactaaattgattctgaacccatattatgattcagtaagataaatgtccctgaaagtttctgaagattcttagggcaccctgatgaccaaaggggtgagagctagggtcatcacgtgacctcattatccttattatctctcagcagttaccgagttaatggggagctagaaaaaattgtttttctcaatcactggaaaacagtaaatgaataacagatagctagttttaaaatttactggatattttgtcaattttctaagctacttgttatatctttctaatccttaagataattgcatttattagaaaaaattaaattggcttagtaaaattttagtcaaaattttgtgtatttgtttaggaaatgaacaaagagattacaatctggatcctgatagttcactggtaaaagataagattataccaacaaatagataacttacacgaaacgggtaaattccaagaaagacacaacctaccagaactcactgaagacgacatatcaaatctgaatagacccataacaagtaaagacattgcgttactaattttaaaactgccaagaagaaaagtccaggtccaggggataccttggtaagttcaaccaaatatttgattcgttttcaacagggtaacaagatgattcaatggggaaaaataatcccctcaataaacggcatatgcaaaagaatgaagctgagttcctacatcacattacatataaaaattaagtcaaaatggataagaggcctaatgcaagggatacaactataacagtctcagaagaaaatttaggagtaaacctttgtgaccttgggtttggaaaaggtacttagatctggcaccaaaaacatgagcgaacaaagacaacatatacacactgaactacaacttttgttcttcaaagaacatcatcactacagtaaaatgacaacccaccaaaaggaaggaaataaatgcaaatcacatatgtcataaaaaacctctgtccagaatatataaagaacatttacaacttaacaaggagaagacaaataacccaattaaaaaatgggcaaagaatctgaatagacatttttccaaggaagttatacaaatggcccaataaactcttgaaaagaagatcagcatcattagtcgttagggaaatataaatcaaaattatgagatgtcccttcacacctacaaatattgctaaaatttaaaacaaacaagaaaagaataacgggtgctgtcaagaacataggtaaattgtaaatctcattcattattggcagaaagggaaattggtacagccacttttaaagagtggcataccttaaaatagtgttaccatatctccagcaacttcccttctaggtatatatccaaaagaaaagaaaatgtatgtccatataaaaactcgtacatgatcagtaacagcagcatttttctaatagcaaggaagtagaaacaacccagatgcccatcaattgatgaatacataaacaaaatgcagtatattcatacaatggaatattatttggcaataaaaaggaatgaggtaccacaagtcgcaaatatggatgaacttttaaacgtcataagcgaaagcaggcagtcacagaagaccacgtattacatgtttccatttaaataaatctcccaattaggcaaattcatagagacaaagtcaatttgtggtagccaggtactcggggaagagggaagtgagcaggggcatggggtgtgactgctactgtgtacaggctttccttttgggaattatggcagtgttctaaaatttgatggtgttgatgattacacaactctatgaatacactactaaactgtacacgtaaagatggtcaatttaatgttaggaaaattaagtcaatcaactgttatttttttgaaaggcagataaggtggtatcttagattccataagccagcctaaaagtgctgaggaaccacgcagtatttgtgtgtgtgtgtgtgtctgtgtacaggtgtgtgtgtgtgtatcagatcattataaggaaggatgtatgtctagagaagtcgtgttaggcttcacatacttttaatacattgttaccctaatgttataaaaacttatagtggatttatattttagacacaagtaacatatagttggccagttgaagtttatttctggaaaacttctgtttacattttattttaaaatagttatccctcaatcagcatgccctacattttcctagtggcagaaagtagtgaccagaataaaaaagcaattaaattaggcaataacattactgaagaggtcactggttctgcttacatttcacttgttttgcctatatatattatccattgaactaaatacagagaagccacattttctcttaatattctcttatggtctagtgattttctttcttttttacatatggaaaattacaaaagctctagctacacaacgacatcaaatatacaagtgtctaattgcaatacaccgggatattttgactaaagagccgtgataactttgcaatgatgtaggacgatgtttcagacaaaatatgaagccaaaaaaggcagaatataatctgaactgacatttcctatctagaatgacagaaatgtaaatgtgtttttctctagtgctgaaggtttggaaaatgctagaccctaagatttaccatggaatttgatgattcatagtgaacatgaagagacagacgccacagtctgagttctatttggtaattcgtggccacaaaagtgcacccctcattgctttccagctatttacacttgccagtataatacaagattcttaattagcaaccatgtggcttcactttaaatagccttgctagctcccttgggacctcttgaaatatcattcatattagtagaaataccatcccattttgttacagatttatttatttctcttgctatcctttttttttttttctgttaaggcatattactgttacatgattataagcattttttaaagttatgggcagggccatgatctaactatactttgtagttacatgacatctaaaaatgtgctatctgattaaaggatgcattttagtaataaagatgatagctatttacatccgataactgcctacaaaaagacagaaatgagctgaaaaatggaagaagatggaataaatacagtttactaatagagcttatacttctcccatttggtttaaagaggcttttaaacacttaagctgagatttactatgaaaatcagacttacaaacatcaccatcaacacagaattattaaaatgtagaaagtgtggatatgtctaggattgcgatcccattatgcagggacctacgacctactagaaatgctttgcaattcttactgaactattttttcatgtaaatgaacatcacaaggacaggtgaactctctgcaggcaccgatcgtctggttttctaaaagtatacagggcagacagggtattcaccttgattggaaacagagaatccaggtatatttgaatcttctgcctccaccatattgtgtagcactatgttttgtttaattttatcagtagaaagaaaaaggccagacaaatgccgtgactcaatcctgtaatcccagcatgttgggaggctgaggtgggcggaccacttgggcccaggaattcaaaactagcttgggcaacaaagtgagagccgattctacaaaaattacaaatattagccgggcatggtggcacatgcctgtagttcaagctagttgggaggctgaggtgggaggatccattgagcccaggaggtcaaggctgtagtaagctgtgattgggccactgcactccagcctgggcaacagaaagagattctgtctcaaagaaaagaaaaaggtcatacaagtttaccactaataggccaggtgcagtggctcactcctgtaatccagcactttgggaggcagaggcgggcagatcacctgaggtcaggagtttgagaccagattgccaacatggcgaaaccccggctctactaaaaataccaaaaattagcctggcatgttggcgagcgcctatagtcccagctactcgggaggctgaggcaggagaatcactgaacctgggaggcggaagttgcagtgagctgatattgcgtcattgcgctccagcgtgggtgacagagtgagtctaatgaaaaaataaaaaataaaaaaatgaaaaaaaagtttaccactaacagttgaagcaataaattttgttttgacgaagtaacatttatagtcggtgattattataaaaaattttgttttaaatcattcacaattgagttcccatcctattgtaagtctactgctaatctattaattgcatgcattattatgttggtcttatgatactacctagtaaataaatatacatatgtgggtcatactccataagtctgaaatacacagtttaaggggctaataaggtatatgtaactaagaaatacactagtatcatcattatctgctgttttatgttttaataacttctatttctgatatttcaaagtgatataaacgagcaagttctatacaaagctacctcatagattctaaaatcactggcctttcaaacatgtttatgggttctttttaaaaaataaacattcggatgctgacgaagtagaaaattagtcttctggagacatattatgatggagccttaagatggatgaaaagtataaactgcatcatccagggctggatttcctgtgcacactgcagaaacgtccttgatgttactgatgtctgcctcacgcttagctctcagagccgaagctccatcaggacagattggaactgccacccagaggcatttcacaatttgaaccaaaaggttttcaggcttgcgttctagctaattctgtcgcttctaattccagccagacttaaactcttatctttggatgccaggcctacagatagggctatcacagtagccccaattcccagaaaatacgcaactccatgacccaggtgagattaaatccttccagatagcctaaataaatggtctataacttgttcctgtcactcccactaatgcctttgtactgtgaaacagactaggaaaggtgtaaatatcttcaaattattagctgcacttcctcttccttgcctctaccaggaactctagcatcacgctcctcatggggcaaaggaaacccagaggcggcagttcctgcactttcttctcctgtagttattaaccaatttgcagatctccgtgtattactggtaatagaggcacactcatatcttttctctttaacaccttgccagtaaaattctcccgcactaacctgtctgcccctctctctctaagaaagatacagacccaattatacaatttagcccattactttggttcaaacagatttcacctcaaaacagatgtacttgaatgtaaaaggaccttcttgtcagtgcgtggggtagctgtgctctcctgtaccccctaaacatttatgtgaagtagtcacatctgaagaacacacacatatataatgggaagtatctcttaagcagcaccgcaggcatttgctttaaaccccccgtaactcataacggcttgactgtgcatccatgcttctcagcagctaggggttccctgaaagcagggacaaagccgtggtcttccttgtttcctctgcacctcacctcgtgctgagcacatgcagactcagaatagatgttcactgaataaaagaaaggatggacacatgaatacattaaatgaacctcaaacgttatctactatgctctgtgcagaatcagtcagaagacaaggtgtctcgggaatgcaaaacgggacaaagaaaacccagctcaagcaagataagcactgggcagtggttccatttgtctgagcgaggcagcacgtcgagatgagacgaaaacacagacactgactgagtaggtagagcaaggggtggaaatcaagaaccaacaagcagcccagtgcccatctgtgagctggggctgcaggaagaaaagttggaaaggtggctgggtgtggtggttcatgcctataagtccaacacgttgggagcctgaggtgggaggactgcatgagcccaggagttcaagacaagcctgggcaacaaagcgagagcccatctctactaaaaaagtgagccgggtgtggtggcacgcatctgtggtctcagcgacatgggaggctgaggcaggaggattgcttgggcccaggaggttggggctgcaggcagctgtgtttgtgccactgcactccagcctgggtgacagaggaagaccctgtcttaggaaataaacaaataaagtaattaattaattaattaatttaatttaatttggaaaggcaaggctatgttgggagggccctgacatagtgagaggaagtatcattatttgaaggactttgaatgtttctcatgtgactggaaagactattcatattcttaccacagcaagatctgaatttgtgaattgtcaagctctctcggtaacattgtttcattttccattattagttttaagtcactttaaaacaaattgtggtaaaattcaactcctgtcccacgacttagtttgcccacatttaaaactattcctgaaataaactatgtaaatttaggagggaaattttaatctgttaaatgtatttagacatttcctattcagagaaacattatgaagccttctattttgtgtatagtctagatttttaactatgaatatgtgtgtgtattcatgcaaatagtattgatggagatgtatagatagatagatgataggtagatagatgccagatgggtacatggacagtcacacagatggagagatggtaggtggacagactgacactatgaagaaaaacaaagaaggctgaagatggctggggtgaagccatctttctactgggtcttcaggggaaggcttttcgacaaggtggctttagaattactacaagtgaattctatccatacaggaattttgacttttctggagttagagatgatcaaatatattttgaaagaaataaggtcctggtcacaaatatgccactacagagataggttagtcctcacgaggcctacacctccccgactctaaaaatgaacaagatgagcagattgtggaactctgggtttcattcttattgccctttgaggggaaggtgcttagaggtaaatgttggcttggagctgactagaatgaactggttagctttgaatttggtatgcagcacaccatatatgttgagaggttatttaaatgtttttatagtttacatggagagattaattattttatttttatgtaaaaattgctgagatttcagcagttacgatcgctgacctattaatttaagtaataatgtaatgaattttatatttttacatctgcagaataactcacaatcctgtgcaatgtttctgatacctgcctaaatatctgtatttactcattttgcatttcttttcaaaggctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctggacacacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctagaatgtccaggctgcttctcactctgttccctaaactctaagaattagctataaattagctattaatcctccattcacatccaattttgtgtagttttaaaagtacaagcatataaaaatagataagccaacctgttccattagccctttaatcaatattttagagaagatgaaaatttgactcacattgtatgtttcacttacaaagcactcctatttcaaggactaaccgtactatagctggtgatatggtttggctgtgcctctacccaaatctcatcctgaattgtagctcccataattcccacatgttgtgggaggcacctggcagaagataactgaatcatgggggtggtttatcccacactgttcccctggtagtgaataagtctcacacgatctgatggttgtataaggggtttcccctttcgcttggttctcattctcttttgcctgccgccatgtaagatgtgcctttgcctttcaccttctgccatgattgggaggcctcccagccatgcagaactatgagtccatttaacctcttttttttttataaattgcccagtcttgggtatgtctttatcagagtgtgagaatggactcatacagctggaatttttttttttttttttttttttttttttttgagatggagtctcgttttgctctgtcacccaggctggagtgcactggcaggatcttggctcagtgcaacctctgcctcccgggttcaagccattctcctgcctcagcctccctcagcctcctgagtagctgggattacaggcacatgccaccaggcccagctaattatttgtgtttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatattatgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacaggattcaaatgtgagtcaatgcaacttggagaatttccgtaatggtggttaaggaaataaattttgcctgctgaatagttgtaatgttcattccttcacctctaggctaaccatttcacttctctgcctaaaatctccagtggttccaccttgcatggttgtttccacgtgtgattgactaggcatacttactagtaaaaaatgtgagcacacagcccccaaagcatcttgtttattcacaaattttatatgcattactctactaagagattaagtacaccataaaatacacactgcttagaatttaagaacagatccaaatgagagaattacaatgttgacacgtggttatttgtttttcactattgagtaggaaaccaacgaaaagcttccaatggtactctaatgctggtgaaattttttaattaccgatgacttcaccaaagtttgtcttcaagttttaggtgatttcttggtaagagcgttgaccatggtctcagcctcacactgttagcagtcagcatcacattgcacaacactccctgaggacaaggctcatggttaatagtggtggatatgaattcttatttcaaatagtgcttaactcttgtcagatctgataaaaccatctttttcttttctttttttgcttgttaatgtggctggtgaagtgccttagtatagtcttcaatactatttcattttgtaagagttgctttagtttaaacgaggatcatgtcaactgcaaaacactattatgtgctacaggagacaaatcaatgctggcacacaggaatgtccgcttttcccaaatgttacctgtgaccatcagaaatattcaggcaactgggagtgggcataccatgagcaaagtgaggggtttttcctatttgctttgattaaaaattaatataaatgaaagtcctagtattttattcctgcacactgatggtatgtttcgcatccgttgggatgcatcaactgattttggagcccaggaaaagtctaagctatttggacactaagctgctacttaggactcccagaaaccccatgcctatgctcgcagctacatctctcaatatcttcatcaacatttatttgtagtttactgtgcttacgtacaacctttcaggtcatggctgcactcaagctgagttccctacctagaaaatccttccttcctatattttactcttaatctaaaatttctacattattcctacttatcctgtaaaagtcagattcggagtgattggaagacatttcttccatgtacttgtgagaattaagggttaacttgtccagtactcattcctcagtacgttggcttgaaaaggacttagccttgcaggctcaggaaagagaatggtgtttccctatcaggaactctaaagcagcaagtgaagaggggtggatggatgtggaatgagatgtggacttgtcactctgccaccaggacgaatatacaaaatctggagtccgttacacttgacattttcacacacagaagccatgcatttttcaaggtactatagcttttaataaaagctctttgtgctttgaagagggtgttggataacagtacatatacatacttgttttaaaaaaagaagaaaattaattgaggccagcatacatttttccatgccatttccaactttaacaccgttgaaattcctttaaattcagcttgaggttcccatggaatcacctctggccacgggccgtcaggtacaatcttgggattaagagctctctgtgaagacctggtgaccttgaccattcagggcatttcagattattctaaggcatatttttaaaagtagggttttttcctacatgactagttttgttaaacttgtaatttctttttaacataaatttcatactgaaacaagttaaactgttttttactgaaagtcagcttttgacagaagcgtacccctccctggagaaacagttcttcagaacctatgaatatgtaacaccaatgacttctagcacttttaattttacaaattcccttctaacggctttaattgtaattcctggcataaaagaggcaacaggataatactttgttgaaatgtttaattgaagtataatacatgtatgtcttttatgaaacaacctcaaacttagcattgcaagcacagtacaaataactatttttaaatcaacaaaaatgatatctatttattgtatataatgttgttttgaaatatgtatgtgttgtggaacagctaaattgagacaatatgtgcattacctcatatacttattttttgtggtgacaacaccgaatatctagtcattagtgattttcaagaatgtaatacattgttattaactacagtcaccatattgtgcaatactgtgcaatacatcactttttcctcctgactcactgaaagtttgcttcctgtgaccaacacctccccgcccacacacagccccaacttccagcccctggcaaccagcattttaccctctacttctcagatttcagtgtttttagattccacgtatacgtgaaaccgtgcaatatttgtttttctgtgcctggctcattttatgtaacatcatgtccttcaggttcatccatgttgtcacagatgacagggtattgttcttttaaaaggtcctatggtatcttattgtgtttataaatataacacattttctttattcattcatcagtcaatggacacttaggtaggtccctacctgggctattgtgaatagtgcggcaaaggacatgggagtgcagacatcccttgacatgctggtttgtttcctttggatacgtacccagaagtgagaccactgggtcatatgacagttctatttttaacttttgagctgttttccataatggctgtaccaatttacattcccaccaacagtgtacaaggctttccttttctccacgtccttgccagcgcttatcacttattatctcttgtctttcttgtcttttttttttttttaagatagatgtcgctttgtcacccaggctggagtgcaatctcatctcactgcaacctctccctcctgagttcaagcgattctcctgcctgagcctcctgagtagctggcattacaggcacccaccaccacacctagataacttttgtatttttagtacagagagggttttgccattttggccaggctgctctcaaactcctgacctcagatgatctgtccccttcagcctcccaaagtgctgggattacaggcatgagccaccgtgcccggccatctcttgtctttttgataacagccatcctaacaggtatgaggtaatatctcattgtggttttaatgataattttttccctgataatttatgatgtggagtattttttcatatacctgttggccatttgtatgacttcttttgagaaaagtttattctgtttctttaccccatttttaaattgggttacttattttctaactattgagtttttgagttccttatctattttgaatattaacctcttatcaaatgtatggttggcaaatattttctgccatttcataggttgtctcttcactctgctgattgttgcgtggctgatacagaagttctttagtttgatgcattcccacctattttcccttttgttgcttgtgcttttggagtcatatccaaaaaataactggccatatcaataccacgcagcttttcctctgtgttttcttctgtgagctttacagattcagttcttacatttacagctttaatccactttgggttgatttttgtatatgaggtcagataagggtctcatttccttcttctgcttgtggatatccagttgttccaacaccacttatggaagagacagtactttccccgttatgtattcttggcgtctttgtcaaaaaccaattgactgggccaggcgcggtggctcacgcctgtaatcccagcactttgggaggccgagtcgggcggaacacgaggtcaggagatcgagaccatcctggctaacgtggagaaaccctgtctctactaaaaaaaaaatacaaaaattagccgggcgtggtggcgggcgcctgcagtcccagctacttgggaggctgaggcaggagaatggcgtaaacccgggaggtggagcttgcagtgagccgagatcgtgccactgcactccagcctaggcaacagagcgagactccgtctctaaaaaaaaaaaccaattgactgtatatgtgtggatttatatctgagatctagagatactataactctctatatctctagagatactctaactatgtggtatatattttaaggcaggtagtgtgatgcctccagctttatttacataactacttttgggagtaagttgctgccatgatgctccatcatccctgaaaactttactgtgtatttcctaaaaacaagacattcttctacacaattggtccattcaccaaaatcaggaactcacattgatacactattagcatttaatccacaggcctgatgtaagttgtctcaattatgttctttcttaccatgtttttcatttttctaattttctcttttttaattttaagttccagggtccatgtacaggacgtgcaggtttgttacataggtaaacgtgtgccacggtggtttgctgccccatcaacccatcccctaggtattaaacccagcttgcatttgttattattcccaatactctccgtccccccacccatcccccagtaggccccagtgtgtgttgttcccctccctgtgtccctgtgttctcactgttcagctcccacttataagtgagaaggtgcggtgtctggttttctgttcctgcattagttatgcaccagctaagactatgccttgcatttaggtgccatgtctcttttggtcctggctacatttgcatataggaaaacaataacaattaatggcaatcatcaatactttcctctatctagttaggttaatctagacatggtgtataaaaacaattacattattaatcttaaaagataagtaaagcgctcatgaaaacggggaaactgatacataaatattttcttcgactgctcatgctgcattctggagacgaccttcactattttttgcacaaatatttgaaaaacatacgcaggtattttatctaaaagatccatgccttcttaaagcatgaaagttggaaaagtggttgtgggtccaccaaactacaaagcccaatttctagaagaaatagagggcatggcacactgctgatgaagaacacacagggcagaaatacataacttgcccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccaggcgtggtggcgggcacctgtaatcccagctacttgggaggctgaggcaggagaatggcgtgaacccgggaggcagagcttgcagtgagcagagatcgcgccactgcactccagcctgggcgaaagagcgagactctgtctcaaaaaaaaaaaaaaaaagaaaaaaagaaatacataacttgaatgaaaatgtgtattagctaaaataaaatggttttaaaaaaaacaggatcagagggttttataagtgagttccactaaactctcaagtaacattccaattccttcatgtttaaaaaaaagaaaaagaaaaaaagctgttcagttttgtttaaattaatttctaaataaaacaggagcaataaaagaaaatgaggatgaaattccatttcacttgtaagtatacatatgaaacagaatccaaataatatcccatcatcaagatttatctcaagaatgtgaggatggtttatcatctgaaaaatccccatcaatgtaatttaaaataggaagaaactgaaaggtaaagcacttattatctcttataatacggacgcaatgacttaataatagtccataactttactattaaagcaaacagaaaagaacaacagagtaaaccaggaatggaacagaagtctctaacttgataagggcaatatatcaaacattgcaaaaatatttaaatttctgggagaactcttagctacattttaacttctgaaaaaaaaaaaatagaggatgatatcagcaaacaaaacaaactccagagatgagaaattgaaactagcactcagaggaacgccagggcagtgggccttctgagcccagaaaggcccggattcacaatgaagggacctagcctcagacggcagatgagagtggcagtgtttagcactgtcccttaggagatgctcagtaaaatgcctctgccagctgcctcctcttcctcacctgtatgtagctgtgaaatcctgggcactgttctcgaaagagcataagatgctccgagagggtcggccttatacgatttaagctgggccaagagggcaagtggagtctcaggggatggcagcctgtgctgtggaggtgagggccacagagcaaagcccctccatgaagggctcaaagcaaaggagaggccttctgcagtgcggccattaagatcatggtctgggaagccaggctgcctgggtttcaatctcagctctaccacttactgcatgactcagtttgtttgtcttgtgccctgcactcctcatctccatgaagagctaatggcagcacctacttcaaggttggttggaaggggtgaatgagttaatccaggtaaaacatgagaacagtctctgttcttcctcaagggaagcctcctgacgcctgaacacacacattccactggtgtatttccagcacaagattctggtgtgcatatgcctccaaaatgcaatagggaatctatgtaaccttccaatactaattaacatattgtttggccacacatattaataaacaagcaggaatcatctgattttggaggtaagtaaataacatgaaaaagaaatgccaagatgcacaaagacaacaactaatcatattaataggactgtttaatggaaggtacatgaaagaagaagaaatcaaagaaccggtgcttctcagactctgacgtgcaagtggattaccaggagatttgttattaataaataaataagaatgaaatgcagcctgcatcagcaggccaggcgtggactctgggattcagcatttctcaacaagcccaccgtgtaacaccaattgttgctggtccacgttccacacttttaggggtggggatcaaaaagataaagtcaagaaatgtttcaggagtaggaggaaaacgacaaaaatatacaaagaaagagatatttttaaagtaaatgcaaaattaagaagtaaaataattctaataggcatccttaaagaagatggcagaaatcagagaggggagaatataattttaaaaataaggatattttcctgggcaataaggataaaaggactagttctccatgctggctacatgctctgattttgggtggcatcaaagaataccaattgtttggccataatctatggaggcatagcttacgtatctgtggtttttaaaatcatagtgaagtgagaagcactcatcacgcattagagtaaaacagcccaaagggtatgcagcgaaaagaagacagaacccaccttgacatattttatggctctaaacggggatagaaaatctgagaggttttacaagaaatataacacctgaaacctacatatgaaacaaatgcccgaattgaattcaccttctcaatagtagtgccaagttttagaagagcagtgccttcaaattgggagagaaatgctataaacacagccaaaccacatcaaaataaagaatggaactaacaaataatgccttcaaggagaaaggagattatatgacaacaaattctacaaatataaataaaatattcattttttaaagatggagtctcactcttattacccagcctagagtgcaatggcgcgatttcggctcactgcaacctccacttcctgggttcgagcaattctcctgcctcagcctccgaagtagctgggactacaggcgtgtgccaccacctggctaatttttgtatttttagtagagatggggtttcaccaccttggccaggcgggtctcaaactcctgacctcacgtgatccacctgccttggtctcccaaagtgctgggattacaggcatgagccactgcacccggcccagatattcttaactataacataaaggcatatgtttcttccaccaataagaaaaataaaaatcaatttctctgagaacaatagagcagtaaaagaaaggcataaatctgaaccaaatatgaaacaaactaaaatatgataagatttttagtaactgatatctcctataaactctgaggtttggaacattattaatgattagtacaggctgagaaacattcaaatatcatttctttctcatggatccaatcgtcatacatacttgcccggccacataatacaatcttataaaccttgtcaatgtaactgtattactacatctgacagaatttaggaggagacaaaaaagtggtgaaaaatgtggatagaaaatgattggttgataagttccatcaaagtttgttgaatacatcagagttaaagtatgtcgttcaaagtaacaatgcacttgatgattacagctcccgtaagtacgggaagaggatggatagattaacaatgggaacaggctgggagaagagatgtggggcaaagaatgccaaattattaggttttcaaggtggggggtgaatgtgcatattttaatgttgataaatcaatagctccgcgatgatgataatccccaaaagaactaagtggagaaacacgtacaagtggctaactctggggaacagaactgaggacatgagagagtgaattccttttttttttttttcattttatgaagaaagcaggaaagcatgtattacatccataattaaagatattttaaatggtaatacaaccaagcagttgaaataacctaaacatttcaacttcattaatatctatttttaaaagcattttgaatcatctgtttctcttagatacttcttcattttacttaggaggagagcagcattctatcgtcatttcttctgggactttgcacaaatcagaagatttgcacaaggcaatactgtggcagcacagaacaactttaacaagttcacggaaaggaaaaccattcacattcgaaatagagctccatgcctctaaccaataccttcccctggcatatgtctgaccttgtcctggggactgaactagagtcatttcctgtgttactcaggacacaagtgtcacgatgttgtatgcactccagtcttgactgactagcccagaagggcaaaaaggcaatgtgaggggcttagtcttgctgcccagccctcactgttcactttccagaattcttatggtaggaaaatttctcagttcaaaagcttcaggttacctgtgcatttgctctttcaatacacatgaggagctcggtgtcactcaacctatccgtattccccatgctccaagagtctcactcagaggtgagcgtagggttagaagaaaaaaatgggaacagttatcatttaaacagtttctcacaacccccatcaggtacaactcttgagtgagtaccaagattccttgcttaaaaataaaaggttgaaggccgggctcaatggttcaggcctataatcccagcactttgggaggccaaagggggcgcatcacttgaggtcaggagttcgagaccagcctggccaacatggcgaaaccctgtctctactaaaaatacaaaaattagccgggcatggcggcaggcgcctgtaatcccagctactcaggaggctgaggcaggagtatcgcatgaacgcaggaggtggaggttgcagtgagccgagatcgcacctctgtactccagcctgggcgacagagcgagactctgtctcaaaataaataaatgaataaaaagttgtaccaagtagtggctaatttataaagcaaataactaatcttttaaatgagagagaacagaagagtttctcattttggagattaaagcatggcccagtcagcaactttataacactgaccaggagaggtacatgcctttgttaaccctggctgttgttactgttatatcactagggtgtctcctcaacaacactgttcctttttctcttttcctgttgctgtgaactaggcatcaggcatagttgtgtatgaagttatcaggaaaatcacaaagatgtgtctaccagggcaggcaaaccccagatcctaaggtttctgtccagcttttccataaacttttcctatttcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggaggggtgttggtaagaagatccaacatcaaattaacttcgacgttcgtattattgtcttggcttggatgttctaattacatccttaagactatgtctgtgacttctagtacctgtaaggaagtttgttaaagagtgaataaaaatgtcaggggaccttctgatttcccatccagggacagggaaaaattgctcttcctcaacaaaaggctggtgagagatgaaaatagttttgttttgattatattgcaaagtgttcaactttattataagatgtgtgattaataataatagctaaaatcaactgagcttaagaagacgtttacatgcatgtggtcagtcctcacaaaaacactatgaggtgtataaataaataaatgtacaagaataagacatttactattctcattgctcagatgaagaaactgaggcacactaaggttgagccagcaggtgcagggtcaacaagctggaacccaggaagttggttctgcagcccagtcctagccctggaactccacagtgcccacaacgctcccaagtgaaatatatgatggagcatctatgggaggtgaggttagggggattttactttttgaaaaatgctttttggtatttgaaatattctcatataaacatccatgacctataatgacagagagagagagacagacacagagatagagacagagccagagacagggacagggacagggacagggacagagaaagagaaagagagagagagaaccattttagaaagttgctggaccagggaatattttgcacaacatgaaatgattacttactatcctccctcctgatttgggaaaattttagaaaattacagtggaaagcagcagcccccaacctttttggcatcagggactggtttcgtgggagacagtttctccacagactggagcagggagatggtttcaggatgattcaagcgcattacatttattgtgcaccttatttctattatttgtactttgtaatatataatggaataattatacagctcaccataatgtagagtcagtgggagctgtgagcttgttttcctgcaactagatggtctcattgggagtgatgggcaacagtgacagatcatcaggcattagattctcataaggagcgtgcaacctagattcttcacatgtacatttcacaatggcggggaggggggactcctggtgtaaagcattatgtttaaaataccatagcctgagatcaaaattttaggcacaaatttaatcacattgaatcctttgtcttctattagttaaaaggttgtcctgctgccatcttggaatgagtgcaagttggaaaatctagatccgagggtttcacatctgagcatgcataacagtgccctggagagctgctaacagtgcagattgcctgcatccagccagcagagtcagggagatttcaggggagcccctgcccagtggaactcttaaaactgcatttataacaaccttcccatctcctttctaggagattcggatacagacagcccatggcaaatgttctgaggagtaatatggtattatttttaaaagctaacacccataaatactacattaaattaaaattcagggatgaatgaaggacttgtagctatgactctgtagctcagagacataaaaagtgtaagaagcaaaattattactcactaagagataagcaggaaaaagatggggacacttacagttttaacggcttacctcttttgtagagccagaaaagtcagcagcggttggaactctggtaacaatacagttttggtcttctacttatgtactctcttctctattactaaattttaaaaaccagaacagcaaacctaaatcaagcgatacagtcgagctcaaagaaagactgagctcaaatgccttacgtctgccccaagagaagctagcattgaactcacacatcctccctgtgagcacaggcttgccagccacagctcaccaccgctttcttatgacccaaactcatgtccagagatctctgattctccttaacagaactccaggtaatcattaataattgagaggaaacaggcttacttggaaatcttattatgcacgatgtttatcaataaccctccatcaggaaggaagcaacaggcagcacctgcgtggctgttttgtgccaggcactctctggatacttgcctaacattattaccctcacagcgccctgaagatcagatgttatcctgatttttattatccctgtcttctcaagtaaagaatctaggctgttaagaacaataactaatttacctgccatcccatgagacacagttgatggagctaagacccagggtggttccttgtgactttcaactttccctttgatattttggcctctcttaatttagctacatgaaatgttaacctattatgtactcttagttcaattttttggtttatttgtaatcagaaatgatacaatatggcaccttctcaatgagtccatcaattcatatcattgtctattaactcaggatggctagctactcattaacaaatgtctaccaaattcctccatggccttgctagatagtataaataaacaggagaagaacaacgcattacaggaaaacagcaacagtctactgcaaacaaggagaatcaagtaagtaaggcaaagacactaaaggactcaggaacatcattacataatgttgaccagtaactattaatataatgcaatataaaataggaatgcaaaggtattgactgaaggagctacaaaattaagagatattctactaaactattaaagtatgtattctatttataaaataaaaataatttatctaaataagttaaataggaagtaatatctaatttcagcaaggaaagcttatcttcaagtttagatgaagtccttaattacaagtaactatcacatatggctgctctgggacccacaatttgagctgagcagcagatcatggtttgccactgggaattctttagtcttgtccaggaaagattcttagaatctgcataatggaaacagttactaagacaccatgtatgtatgctttacttgctaacttcaaagagttctagagttctgttttcatattttctgagttattttgttttagcatgaaagtatatttagaaagaagggctacttaataatatttctttaatcaaattcttcatataaaaacttctggtccaaataccatttctgctagaaaaatttacctgcccctagtatacaacagtaacattgctgtcaagccagtgatgcatcattgatagaaatgcattggccacagcatgaaacagtatcacatggtagtttttatgccactgcacatgagctgacagccttacttgggtcttgcatgtagagctctcacagggcagggaaggtccagaatacagcaggtttgactgcacatcccaatattagtggtacttttaaaaaatgactttgggtcacagagttctttacgagtaagaactggggataattgagagggctcaggtatctgctacttttaaaaatggcttataggacattaagagtcataagaaggaggctgggtgcagtggctcacgcctgtaataatagcactctgggaggctgaggcgggcggattgcctgagctcaggagttcgagaccagcccaggcaacatggtgaaaccctgtctctactaaaatacaaaaaaattagctggacatgatggcgtgcaccagtagtcccagctacttgggaggctgaggcaagaaaatttcttgaacccgggaggcagaggttgcagtgagccgagatcgcgccactgcgctccagcctgggcgacagagcaagactccatctccaagagaccaaaaaaaaaaaaaaaaaaaaaaagcatcataagaaggaaagtaaaaatgattattcttctagtcgctttctggattctttgcctttcattgcttctatagtacatattaatattacaaagaaatctgaattggaatagacaatcatttcccttacatataaaaatgtaactgaataaagacattaccctaaccatcctggggttacattcctagatactcttggattccatctacaccttctcaactaagcacttacagatgtctggctttatatatgtacacatcagtaactagaactaagtgttgaggtaatgaacaacaaggagatgacagagtgactaactctggccatgatgaaaatggcagatctaagatggaaattatactaggaaattccccaatcctagaaatacagttggccttcctccctcccttccaccttccctccttccttcccttttcctctttcattttttatttcctttgtaagacatctagacaaagtttaggtgctatataactcagggacaatcttcagcttcattgtgtgagattttattcatgattgccttatcacacacaatgacagggagtaggagaaacctcatttgagtatataatctgctgagtgtgatgcaaatgtcagtatctgtggtatctttgcagttacaacccactggtttcctctattctcttaccacttagaggtgaatttctaattctaggaactggtcgtcatcagaaattgatgaagacttcaagacgttaaatcaattcagccactgctacatggtaccttatagaagagaccattaattatactaaataatgtctattcatttattcaacaaatatttatccagtgcctacccactggataaaaataaccaccctgagtgtttagatgaatgcctaatgacaagggtgatgcttatgccattctaaaagtgatgaattgaactgaacatttatttccacacaaaaacctacacacagatgtttatagtagctttgttcataattgccaaagtttggaagcaaccagcgtgtcctcatagggtgaacagataaataaactgtggtacattccattcagacaaggaaacgccattcaatgcaaaaaaagatatatgtgaccaagccatgaaaggtacaaaagaaacttaaatgaagattatcaagtgaaagaaggcgatatgaagaggcgactttatgattctatctataggacatcctggaaaaggcacagctataaaaagggtaaacagatcagcggttgctcagggtagagggaagaaatgggtgatgaggtagagcacagaaaatctctaaagcagtgaaaagactgcacaatcctacagtgttggatccatgtcactaaacatttgtccaggccctagaatgtacaacaccaagagtgaaccctaatgtagaggactggctctgagtgacaatgatgtgtcaatgaccagttgtaagaaacgtaccactgggggtgtgccgggcgtggtggctcacgcttgtaatcccagcactttgggaggccgaggcaggtggatcactaagtcaggagttcaagaccagcctggccaagatggtgaaatcccgtctctactaaaaatacaaaaaaattagccgggtgtggtcatgggggcctgtaatcccagttactcaggaggctgaggcagagaattgcttgaacccgggaggtggaggttgcagtgagccgagatcacgccactgtatcccagcctgggtgacagagcaagactctgtctcaaagaaaaaaaaaaaaaagaaaagaaaagaaatgtaccactggcggatgggggtgggaatgttgatagtggggaggttgtgtgtaagtaagggaatgaggttgagaattttccacaatttccacacaattttgctgtgaacccagaactgctgctctaaaaaacaagtttcattaattaaaaatcaaattgctgctttcaaggttcatggttcacagccacataggagatgggtgtcttagcctcatgtaaggtggagaattagaactaaaatccttatgtagaatggagtcctagaaaaccaatgactttcgttaaaggattgactagaaaaaaaaaaaatctacccatcagaacaggtagaagaaaacttattgacctgatactagaccttacatttgatggtttgtaatcagagatctgctcttccttcgacaaaaggtttaaccttatactatttatatagtccatttttcacaacgctgaaaaataaacataaaaaagtagttacacactgcatgccagagacaagcttaaaactatggtgaagagacacactgccagcctgccacgaagcagccccacaaagcccaagaactcacattctaacacagaaaccttgtgaaaatataatcttccaagggagagaagcaatacacccagtcaccatcaggattagttacctaagaaccacagacacagaattttgtacagatatcattaaattactatttttcaaatgattaaagacttaatggaagaacattgaaatataaaacaagagcaggattccatcagaaaaggcagtgacattggaaaaagaatcacatagaaaacccatcaatgaaatatccattctttgaatgccactgggaatgcaaaatggcccaaaaatggtacaactatgaatatacaactaagggcaaaagaaaggtatgattaaattacctggaatgcagcacaaagagataaagtgatgaagaacttagagaggaagtgagaggtactgaaaaaggaataaaaagtccaacatataatgaacttatattctagaattagaggaaaatgcaaaaggaagagaagcaatatttgatgacactggtgtatatttttctagaaccgatacgaatgttctcatacaggaatcacagtgaatacggaaagaaagccaaagctgaacgcatggatgtgatagcgactaaccacaaagatttgaaatgatttctaaagctgcaagagagaaacagattacctccaaaaatactgcaagtagactcatagcatacttaccagtagcaaagataaaagctatacgctatgtcttcaaaggactgcaaaagaataatctcaatatagaattatctttcctgtaattcagaaaataagacaagttattcctaaagaacaacaaggtgggtgatgtgaaatgccttgtcagataccgcaaattataataaaactatagtaatataacaacgtagtattggtgcagggaaagacaaatagacaaacagaacagagtagacggttcaaaatagatccaggtatacatagaaactatatatatgtcaaaggtgtccttatgaggcatgactgttcaatcatgggaatacacaacaggtgatccctgtgaagaaaataaaataaaactggatcttgcgtggacagcacatgtacacaaagataaagtccagttgttaaagacctatatttaaaaactaattttcttttttctgagacaaggtctggctctgtcacccacgctgtaatgcagtggcacaatctcggctcactacaacctctgcctcctgggctcaagccatcctcccacctcatccccaagtggctgggactacaggtgcaccagcttgcctggctaattttcatatttttttgtagagacgggtttcaccatgttgcccaggctggtgttaaactcctgagctcaagggatccgcccacctgggcctcccaaagtgctgggattacaggcatgagccaccatacccagccaaaaaccaaaactttaaaatgtatacaaaaatattctttaaaaatattcaaggccacaacatatgaaaactttcacattagacacagaagatacaaatcataaacaaagatgaagtaagttttccacattaatgtgggaaatcttatacatccaataacagcatcaaagttaaggagacaaaccagaggttgacaggttatttgtttcctacgttagccccaaaatactaatatacattgtgcattaaaataattcacattttaaaaccatcacaggcccatgagaaagtttggccaaagtatactaaatgctcagaagacaaaatgcaaatgaatagtaaatgtgaaaagatgcttaattgagaagtaattagagaaatgcaagttaaatctacaatgacagaaaagtttacaccagtcaggctcaaaatttaaaagtctgaaaatattaaacgttggcgaggatgtgaataattgggagttaaattgttatgatcacctagcagagcaattatttagtatctattaatagtaaagctgaagttattggtgcacaaataccacacccaggaattggtctagagaaagtcttatacctgtgcacaagacttgtataagaatgttcagtgcagcactatttgtgaagcaaaaaaattagaaacaccttaaattcccaatagcatgagaataaatccattgtgatgtcacacatggtatgctattcattagtgaacacaggtgacctactgctatatccactaacacgcattaatctcaaaatatgattgaacaaatatgttcagttgcatacaataggtaacatcatatcatttatttaaagtttaaaagcatgcaaattagcagtattccatattacttataggctggtaaataaatgtttttttttctttttttttttgatggagtctcgctctgtcgcccaggctggactgcagtggcgcaatctcggctcactgcaagctccacttcgcgggttcacaccattctcctgcctcagcctcccgggtagctgggactacaggcgccccagaccacgcccagctaatgttttgcattttttttagttgagacggggtaataaatgtattttttaaagtataaaaacatagttgataatgacaaatcccaagttcaggataatagttacctctgtagagaaggaagaaatggaacacaatcagagagcagtacatccatcgcttcagttttagttgtaatatttttcttaagttgaatggtgggcccactagtatttgtcatataattcccatattgttttccatccctggggttttgcaataacaattacaaatatgtatctccctacaaagtttatacaatggtttatatataattcattcatctttgacttgtaatggaaatctgacttgcacaggaagtcaagattgctaatgtcagacttgcaaaagaacaagcatgctaatcaaattcaaagtcactaatgtaatttccatgtatttctattatagttctcgatttagattctacatctaacctcatcttgactgagaatgtatgtatagattctcaaataagctttatctgaagaatgtcttactatatattatttggtagcactaggtatcaaacactgaggctcaaatttatatttctgttctgttctaacctcaacaacagacagataaacaaacttcctactggagatcgccacctaaaatttatttgaaaccttaaacctctcaaataaagtttatttgaactgcccctcccacaataacccattcctctttttcttccactctcctctgtgcctggtggcatcaacatctaacatgagttctatatctcacatagccaagtatcaatgtgtcatacttcaattttctctttcccttgcatctcacaatgcgtacatctgctagtcccattgacacaacctctaaaacatcacaaagctacatgtgtccctccattacaacgtctagtaccctagcgaagccccatgctccgtcccccaaacacctagactagcctcccaattagcctccttgcttccaccaacttccagccacacttacctcccttatggccttggcatgtgcttacctaatgcccactctaggtcctttgctccctctctctggaatgattttctgcagatattcccagggctggctcctttagctttcagctcaaacttcaccttccaagagaagcttttcctaaatttccaatataaggtagtgtcaccagtcctcagcctattttaattctttccaagcacttatcactaactgaaatttaccatttttattgctttacttgctttaaacctgaagattgtatttggttgcatgtaccggaatactgactacagaagtataaccaattggggtttatttttcgcatgttacaagaagtctaaacaaaagccatctagaactggctgggggctccctgatgccctcagcaacccaagtttcttctatccttctgccctgtccttttagcacgtggcttttatcttcatggcactctgactaaaagcattaataaccttcttgcacatggaatgcaggctccacaagaaaagggaccttgtctgtcttacccatcaccggaagaatgacaggtgctgtgttaacagcttgatcagctagagcagtgaaagaggaactcaagagtcctcaacctcagcatcattcctgcatcctgggagtcctgcaccacagcctccattcattggccctggagattctacccggatttctcttctcatgaagccctggccttcatggccttctttattggccctgccttagtccagggcttagtctcacgctacagtctcctaagtggcccgccacctgccccatttcgcctgccaccctgtcacacccacgacacaaactgatcatattcatctctagaactcttatgttttcttaaagtctgcactcaaatagaaagctccacaaaagtggggacgcaccggtcctgcttaccactgctctccaggcctaggaaccaggagtgcttgctgtggaggagacacttggcaagtatttattaacagaatccaaggaagcatctaaattcccgaagattatgtgcaaagcccctctgcgtttgacccggctcatcctcttcccggtatcaccttcctcattctcacttttgccatttgtttagtcacagcaaataattgtaattctaaagtagtgccagacctttgcatcttttattttataatatctgcataaaatattccttccttttaaaatcagaaatcttctgttcatcacttaattcccagcttatgattctcctcagcttagaggccttactgactcagcctaggggagcagacagtgcctcctggatgcagcactttgatgatgatgacgatgacgacgacgacgacgatgatgatgatgatgttaaaatcacaatgccagcaactgacatcatggggtgttacaacgtacaaggcactcttgtaagtatttctgtttggtgactcatttaacccttgtagcaaccccatgaggtagataacacaatttttctcattttaggagaggaactgaggcacagagacattaactaatgcaccaaaggtcaaaatggcataagctacattccaacccatgtggcccacctcctaatccatgcactatgacttgtggacatatttgtacactgtgacctgaaagattgttgggagcagggctcataccttatgatacataatgggtgcccaataaaagaccgttgagtgaacagattttaaaacaatcagttgtataaatacagaatggggaaactggcttacatatatatatatatatcttgtaaaaacagagttggggtttaaatggactgtatggctctctaagtcatatcattgatcctaaaaataaattacaggccacattaataggcagattataccaaggggcatgtagtaactccagcatagatcaggccactttgagaatctagtacagtcctctctctttagaaaagaccaaatggagttcgtccaaagtaggtaaaacatatggctgctaaaataggaagagaaataactgaagggcatatggattatcgtcaagtatctgagaaagtgttatgtacaaaaatttcttctgatttaaaagggcagaacaaatctaagggtggaagaacaatgtgctcagataaggaagcaaattccagttgtgtgtgctgggcccactcaggctgcctcctaagaatggacagggaacacctcttcccaacgccgccttcagtgttattatgttggtcccttaaaaaaaacagggctggcaggttttgcagggaaactccaaagtgacaatcagagctttgtatttatagagagtcagtttacctgcttatcactgcatttatcccatttagttgctaaaaaaaaaaagaaaaaaatggacttggttgccttgtggagaatggatagtagttgagccttgtggtgaatggatagtaattgagaatgcggcagagagagatgacttcgtaaccaacagatacatatcatcaatgcgcacagaaacttaaggaggggccaatgtgatacgcgaactgttgtcagtcctttacatttagttatttttaaatttatttttcaggaagtatctataaaaacactatatgtaaaactatttataggtcaggaggctgaggcaggagaattgcttgaactgagacccaggaggcagaggttgcagtgagccaagatcgcgccactgcactccagcctgggctacagagcaagactctgtctcaaaaaaaacaaaacaaaacaaaaacaaaactatttataggttaaacactctttataagtaaaactcatttatttaaagaaacagactgatatttttatagttctctcatcaatctcttctattaaaaacaaacaaaatactaaaagaaaactgccaatcattttgaataagagatggtccactacattcctccaccagaggcaagaattaaaaatttaccaagtcaagcaggaaaccctaaaagattatcaacaaatgtattatatttttcaaattcgtaatgcaaaatctataggtatgttttctaatcagtccaagactccaaagtaattagtgaatttattgccattttcaaaaagtaataccccttgatatttaagtttcaatagtatggttttaataaactgaaatgaatcattagaagaatttcccccctttatcataactgattaagtctattttaaagcttatatgccctcttcagggaaatctttaaaaatttccaattgtttatatcagtgaacagggctgaataaccaatgtataattggttaaatcagatacattatttccccctcaaaacaatgccattgagttgaaggcaaaggatagaaatgaactcaccagctatatacaatattatatgacataagcaatattaaagattggtatataagaaaccaagcttggctgggcgccgtggctcatgcctgtaatctcagcactttgggaggccgaggcagacggatcatgaggtcaggagttcaaaaccatcctggccaacatggtaacactccaactctattaaaaatacaaaaattagctgggtgtgttggcacgcagctgtaatcccagctactagcagggctgaggcaggagaatcgcttgaatccaagaggtggagactgcagtgagctgagttcacaccactgcaccccaacctggcaacaaagcgagacaccgtctaaaacaaacaaacaaacaaacaaacagaaaccgacctttaaaataaatacaaacacaaaaagattagtatgtatttaatctgcaaggctaaagccacacaactggatttcagtgtactacaaaatgacagatcatataaattcaaaatcttcattctgcttatcaattacagaggcaaaaatataactatttaagtgggtcttagaatgtattttctcttcagagtgcttcctgatcctcttgccctctattttacattcaagcgactcatgaattcttaggagaaatctgaaattacttcatgccccttgttaaacagattttgaatggtaagtactcctgcaaaattgctcccccaaataaaatttcacatacagatacattcagtgcattaaaaaagtaaactccattagaatagaatatagtattttcttaagataactgtttagacttaactcaaaggagttcccacaaatatattctgttctcagttagttcaagtgtggaataggcaatttggcatggggtaaatctgtccccttttgcaatgttttaaaacagaataaatcgtgggatgaatttactgcgcattacaaataaaatgtttatattttctttgtgaattattcatcaaattaaactaataacatgttaaaatttgcttatgtgtcagtcctttgtaggtaaaatttcatataacactcaaaacaaacatataaaatataggcattattactatctacacttcatatagatcagaaaaataaagactggagagcttaaatgacttgtccttcccagagagtctgactttagagtgattcatatctactgtacttcattataacagtgtatttgaaagtctagttgaactcttaagtgatttcatctagtgtatgacattcttgaagttttgacttctcatttatatatagcaataagcacatgtgtaggatggcatcataaaactcccttggaatgaaaaaaacatataaaaagttttaggctcctacaagaacagcatgtatctcaatgttcctcaaaatgagaattgactccaaggtacaaaacaggtaaactgaggaagcagatgttaattaaccactttagcaggttctgaagttcttagtgtccaaggtttaaataacactagaactatcttaaacaaatgtttgtgtttatttcctgttttctgaacaatgtttttgatgaattacgcatagatggaatgcaaacacacagacccaattccctttgaaatatgtaagcctataaaaatgagcagaaaatatccttggcaaaacctgcactgagctttcaaaagcccacatatttgaaattgagtttgtgatgtactcaaaacacaaacatcagtgggttctcgcattcctcatttctccctctaatgtcagaatattctattaatttaaaaagcagagttctgtgccataattagtctacatattaaatcttatctgagtgacacctctgaatgcaaagtatccagaacaaataataagacaagaaacattccatgcaaaataaaattcaatgacagaataaaatcttcaatccaatgcagtttacacaagtacacccacaaaaattataatttttcccaggaaatgcattccccaaatgaatgtatgcttctctgtgtgaagacatatatgtacaaaaggctaaaacattttttaaaaatccaaaaacaattgatactagaacactatactgacaccaactttataaatcatgggcttgcccaacaattcagtaaatacttgatgttctgcctccattcaaatgagtctgtgcatcctctgatttagcacatggccaaagaaagatctttcagcccatccttctgtgctttacaaaggctactatggcaatcttcacttgtccaatgtgaatttcagttaatttaacttctgctgctaaattgtttatgataattttatttttatcaatattaaacctaatatttgaaaaaaaaagttaacacaacatattaggccagactctcccattcccatttaattgtgttttctgtgtcttatgggcatcactaaagttatactttaacataaactattataacataaaggatcacatcccacacatttaacttcatctgccatttaacttatatctaaggaagatcaatgctggaataaatatttactaatggtaacttattaattaaagctatgacccaagcccatatataaatagaaaatgaaggagcacacatactcccatatgtattcatcataagtgagtttggtatataagcttcaaagaagtttctcatatacaatcttattgttccttgacagtcatctcaggcttgttacaatgacttagtaaaaagggaaaaaagtaaagatggaatttcagtgaatcatctttgggttcagagcttttgggtgtatagacacaacctctcatttcttaaattcttccctaaaggatgatgactgtattaagcaaaatctcagataacatcaggtcaattggatgatggaatcttagtccaataatggagacaacagaatatctgaaactaggacttcagtgaacagtaacacagtttcagtatggcatctcttctctgtcatttatcaggtttcctgtaccctaataagatgcatcctatgttaagagtttggagattggattgctgcagagtttcaccctctcacacattgcttgccttggaatgtgagtgtaatcacaatggaaacatctatgagatgagagcctattaaatgaatccacagactatatatcttcagcatcttataagctataagaatcttagctttttttttttcttcaagtctatgcttattgatggcaatcctcagagatgttttgtaagtccacatgggcacagaaatgtcaaggcttcctttcaaagaaaaataacatttctgagagttctgaattatgcaaagaggtaagtcattcagggatactttctgacatgtagaggcaaccagacacaaatagatgaaataacggtcttcccaaagtgagcatttgccctgtacagatgatcattctttgattctagactcggacacgtagcaacacttactagttcgtataataatgtacctgttctttggaggaactcaagaggatatgtacatttgcctaaataaaggaggccagcagtaagttccatttgcaaggcaaaccttcagagagaagatgcttgtatcagtcctgtagtgaatgagcatctcatttacatgaccaatctcttacacagaaataaatcactgcgtgactgtgctctgggtataatggtattgagcctggcctccttttatcttataatcagttaaaataggaactatattggtcatttgcagaattcttttatatacaaacaaaaaatcatggtggaaatgtattcagtgctctaaattgatactagcctctttctgttttatagtcaatagaaaaagcaatctctactaaaaatacaaaaattagctgggtgtggtggtacatgcctgaaatcccagcgacttgagaggctgaggcaggagaatcacttgaacctgggaggcagaggttgcagtgagccaagatcatgctattgcactccagcctaggcgacagagtaagactccatctccaaaaaaaaaaaaaaaaaaaaaaaaaaaatttgaataaattaccaaaaaaaaccatgaaatttcaataaatttagttcagaaatgaagccattacatccctaaattctattacataaatatgttactaatgtttactctataaccacagcagatcatctgtttccttttttttttttgaaacagagtctctttgtggcccaggctggagtgcaatggcgcaatcttggctcactgccacctccgcctcccaggttcaagagattctccgcctcagccttccacgtagctgggattacaggtgatttttgtatttttagtagagacggggtttcaccatgttggtcaagctggtgtcgaactcctgacctcgtgatctgcctgtcttggcctcccaaagtgctgggattacgggcatgagccactgtgcccgatctggctcatttatttcctaaaattataatgtatgactaacaaatcaatttaaaaactatgtacaactggagtacacaattgtcaagaactatttacttttgcttagtttaaatatttggtaaagagtttgcaaataaatactcatcatgtctattcagatctataatgtgctaaaaattctgtttaagacttcaagaaagaggccaggagtggtggctcatgcctgtaatctcagcactttgggaggacaagatgagtggatcacctgaggtcaggagttcaagaccagcctggccaacatggtgaaaccccgtctctactaaaaacacaaaaatgagccaggcgtggtagcgggcgcctgtaatcccagctactcgggaggctgaggcaggagaatcgcttgaacccgggaggcggagcttgcagtgagcagggattgtgccattgcactccagcctgggcgacagagcgagactctgtctcaaaaaaaataaataaataaataaaaaaaggcttcaagaaagaggcattaatgtctctataagttttactcaccctgtactcttagtatgaacaagtctttaaatgtgtctgctaatcaattaaattatttttctcatttcttatgttaaatatcactcattgaatacatactctccctttaaaagagagacaaatagcaagcttattttctaagaaagtgatagtttcaattcctctgtgaaagtggacagatatcctaggttttttttaaattcaactttatattaaaatgcttacacattctaacgcagttgtaagagatagcagagaaagatgccagctaccttttccccagcttccgccagtggtaacatcttgccaagctagacgttataattgtactataagcattgttacagtcagcacagaggacggccgtcaccaaagggtcccttctgttaccctttcacagtcgtaccctcctctcacctgcttccacccccttcagaactgctgggaagcatgaatctgccctccatttctatcattttgtcgttttgagaatgttatataaataaaattattcagtgtacgatctttggggatgggctttttccacacagcacatttcccctgagatccatccaagatattttgtatatcaacagtcggctccttttttactgctgagtaatattctagggtgtggaggtaccagtttgttgaaccacagatccactgaaagacatcagagttgtttccgtgttctgctaatgtgaataaaactgctataaacattcatatacagatttgtgtgtgtacctacgtcttcatttctctaggataaataactaagagtataactctgtcatctggtaaatacatatgtcattttttatgaaactgctatattcttttccagagtggttctaccattttatattcccagtagcaatttgcgagtaatccaatttctccacatcctcaccagcatttggtgttgtctttattttgtattttaatttacctactttacctattactctagatatttctttatacattcttaacttgtcatgctctactgcagttgctattttgtaggtcaagtttagaaatcttacctttccttgcatctgtgtttatgtttgcctgaaatgtttcttctacatgtagaactacattagacaatgctataacttttgctgcaaccctctaacataatttagaaaactcaagaggagaaaaacagtgcattgtatttaaccatatttttgcttactatgtttttccctccttcctagtgttccaaaattcctttttttgttgtttcatttgtttagaaaatttctttagccattcttttagggtaggtctgctggtgacaaattcgcttagtttttctttatctaaaaaaaaaagtattgatttgttctttcttcctgaacgacattttcactgggtataatattacaggttggcagttcttttctttcagcatttgaaaaacattgtgccacttccttctagccttcatggtttctgatgagaaatccactgtaattagaacaatgttagccctatagggaaggtgtgatatttctctggcttctttcaagatctaaaatttgtctttagttttaagaagttgaattacgttgtgtgttggtgtgggtttctttgggtttttcctgttttagattcactcagctttataaatccatctataactttatgtctcttgcaaactttggaagtttccaacacttatttctttgagcatttgcccaccattatcttctccttccaggaatcccctgacacaaactttaaatgctctgttggagaaccacaggtctctgaggctctattccttttttctttttccagcctaccttttctttgccatttggaccgtgtcatttctatgttccaacttccagttcactgactcttttctctgttccttccattcttatgtcaaacccatcagtgagtgttttatttcagaaatttcaaacaagaggctctccactcagcctttactagtgttggtggggacaaggatagggccgcagtttttctgttgcatttggctggagtagactggttattgtctaaatgttttctatgttgctaggcagcccctttctgagtcctctggataaaaaacaggccattgttggggatttcttccttccttcctttcttccttttcccttcccttcccccttcctttacccctcccttctctctctctctctctctctctctgcccctcccttcctctctgcttcttttttcttctcttttctttttgtctatatatgttgacatttcctggttgccagcttcttcagttccacatctgaggtaacgtagcaaaaagaaaactcaagaaattcacctctggattcttccttgggttctaaaatccctactctgtccacattcttctcactactttcagaatcttcctaagcttgtacagcggacccttgaataacatgggttgaaactgcatgggtccatttatatgcagattttcttctgcctctgccacccctgagacagtgagactaactccccctcttcctcttcctctttagcctactcaacatgaagacaaagacaatgaaaatcttgatgatccacttctacttaatgaatagtaagtatcctctctcctttttgtaatgctgttaatgttttctctagtttttttattataagcatacagtacatattacatatgaaaaatatgtattaatcaactgttcatggtatcagtaaggcttcccgtcaatagcagactactggtaaagtgtgaggggagataaaagtatacatgagttttgtctacatagcggttggcacccctaactccatgactccacgagtcaactgtacaatatgcaatgtctaggctttttagtgtagttgctgggaggaagagggaaaagtatgcctactccagcttcccagaagcaaaatctgtgccagatcattcgttttcaatgtctatattttttccattttcctttaattttttaaagttcttaaagtcttgccaataacaaaactgaacagatgagtgtgtaatgaaaataactatactctaacagtgcttctctaagtggcctgtggatatgctctcccagaactgaaaattctatgaaaattttttagatgtgacatcaattctattataatcttacaaataccctttgccagttaaatagacaaactcgctttttaaaattatgacatttcataagactgtggtctcaagctatagttccccaaagtacctgaggtgaggcactaaaactaatttcctcctcaaagaaggtgaaactaagtgtgagagatactgctcagtatgtggggtgaccattgcctcagttttcctaggacactcccaacatataattttgtcctggaataattattgacagggtcttcttttatactcacaatatctcattttgcatgataagctaatatatatgttcatatcacctatgataaagaatacgaaaccaggaggaagacacccagcaagcatagacaccaccccagccatctcttcttctcttcaggacaccaaggtgtatatttaacattcattaatggaagcattaagtagctcatatggaaggtccatcttctttttctcagcagcaacttattattagatattttgtgcttatactgtgaaatatagcacctgtaatgataatgggtaactaaatgatattgactaaatagttgtaaacatatgttctaagattatacaagaatatctaggatgctaaaattctgccagttgtacacttaaagaaaacatagccatcaatttgcaattacatgtgtaacttcctagtctttacagtgaaactcttctatgaacaaagtttgccaacttctcggcacctaaatcatttaactgtgatttaatagaagttccataagtatgaacctttctttttcagtgtcctcagacacaagttctcaacagccagctaggcatctccaaacacacgtactcagctggcatcaactcccatcatgttggaacaatgcagcatccttcccccaaccaaaccgggtcttcagacttcccatttccttctatggcatgacatttttctctagttccccaccaatgaaacttcaatgccaagttagtcaaggttatgtgaaatatagcccatattttattttttgtccaatcttcaacatctctcttcaggttctagaagaacaagaacccatcctttttggcaagcattctctatgctcattcccctattcctccatctacagaatcctacctcaactcaattcatccaagaagttcttcctggtgacttccaaccagatgtgttttctccacctttaaaacttcataatattttcaggtgcgatacggcagttatgtttcatattcttatattatagctattaggttgaacaacatgaaattgttgaacctgtaaaaatggcaatcccatatggttcaatctaatatttctctcggttttagggctcataaataaagagcagtctccatgaaaacaggggctgagttaggtctctcttttggatcccctgagaagcctaggacattggaagtgcttaagaagtgtttgtcaaaatagactcataaatcaacacatgtcttaggcatatatgtttgcaaagtcaatcatctgaagcaattagtctaactacatatgaaatcgctaattgttttatgaatcagcacaaatggcagtttagaacctgaaggttttggcaatataaaatgttttgattcaaggagctgttttaaaattatttatttgtgaaggaaacatccttggatttagaggttggcagatacagtgaaaatctttttagttgactgaaatagaaaaaaaaaaaatcaaaaccctttttagcacatgcacttcccttataaaaccaaattgcctgaaagcagaggccagcagtttgtgcacaacgagtatgtgcctcaacaccatcagcaggagatgcaatgcagaatgacaggaacaatttgcatttctgtagcttctttgtatacccaaattctgagagcattttacaaagccataaatatcgttacccacaagagacagggaaaggatgcagatacaaggacggactttgtgtactctgacccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttgagttgtatttgcgagtttccccaacaaaggacgggtctctagttctaggtgatggtggtattatcagtcacctcaccagtccccctaattcctacaaaaatcaccaatccgaatgacatgtgtgtagggctttcatggggctaggagcagtgggctgccagaagctctgctggggccaggagagaagagagcatcgttcacacttattacgttgcaggggcctatttccagggacaatgttactgaaccttggagaaattcatgcaaaggtatactgttgttgtgctccaggcttccttccccatcagctgcagaactgtgcgattctggtcctggccaaggagtgcccaaagctagttgccaatgggccccggagcccacacctcctctagcgcagcatagcagcagccctcactaacctccaggggtcacaattgggttacaaattcctcacagtgcagggactgagcagcctgattgggaacaatttattcgaatccttcttcgttaagattcaaatggaataagtaaggtagaaattgaacagacacagaaattgtgccttgctgctcctgtagtcagtagacatttattcactaagcctagctcgtgtgttctttctctctctctttctcactcgcagttgttcttccaatctttcctgcttgctgttttaatgcataattaagaaggtcagaattaatgaagcagtgtggagtaaagttcaaggaatccccaggcactatttattctattagatctcaggcatgaatgtcagattggcagcgcaggcggcatgagcaatggagctggcggcatcccaagaacggccgccaagggagactcacctgcacagtccagtcattcctcagctccttccctgcgaaaatcacacgcaactggtcagccggaaccccctgtcgcttagcaaccacctccttgagctggaagatgctggtgtcagaatcgacctccactgggaaaccatggctggagttgaacctgacaaacactgaccaaggaaattggaagggagaagagaaagtgagcatcactcgaagcccttaaatggtgatagcaacatttctcaaccgatttacccctcgcagcccttcagtgaatggtatatattttctttcacttacaacaaaaaacttaatgctatagagcaatatttgggaaaaacagagttagttacccacgagatttccctttcatatattcgtcagtgacctgcaaaccaaaattgcattctccctttgacatccatcctgggaaacagagagacttgagcaggacacttgcttgattggaattgaaagagtcccatgagtttattgaaaagactcagctctgacagcatgtacacactcacactccctccacagtgaccctcttaataaaaataggaggcgatgtgttagcactcaaggtatagcaatggaaaaaaatctaagctgctctatagaccagagtgaagacccactcggggctatggctcagagccctagacttgggtggtcctggccaaaatgctccactgggtctatgaagacaattatttgccctctttttggcagggagggggtggagacactagtgacaccatttgtcttattgaagccactgttccccgtgagacccaggctgcatcctctagtctgtctgtctgcatgccgtcttctcactgcacctgctgtcccacctcttcagcgtctctcactgccctttactttccattctttctctcactgcttgaagtcacgctctcatcacatcttttctagagtctcataatagcccccaactggagtcttgatccacgccatcacctccaaaaggccctacatagttctgcaaaatgagccttattaatacagagctatgtcacaccactcaaatcctttaagtctcacactgtcggctggtgaggaaagactccaagatccctttcatctagcacaaacctacattccagcattttcttcattaatctccatgtgtactcttttaaactaaatgctcccagaaaaaaaaaaatcacaaaaaactgctgcacacaacttcttgcttttattcatgacctccctccttctcctcttcctattgaaatcctgcctacctccatggcccacttcaaatgtgacctcccccaagaagcttctggctatcagctactgcaaaagcctgatcttccttattcagggcaccagtggcatttactatatatgtcttttaatattcaccacattcctcatggaagcaggatagcacacgggttaaaagaacatcctgaagcattaggaagacctatgaaaaatccccacagactcctttaattggcttaggatgctaggggtcaatctattaacctccctctttaggtctcagttcccttatcttgaaaacataaataaaccacagaccatattattcggttcattaaataatatttatagtatttaaaactatcgtcttgtaacatttaaaaataatggacatttagctgtttttgatatacattttgccttctttaaaagataacaaactcctcaagggcaagtgttattgtttatttactgctgtgtttcctttaaatgtagtactatagctaattatttctcaataccaatgtgagatgacccacctcatcataattataataatcattacaatgccaataataatcaggcacttactatgtgccagacattgtgctctcatatggtttttctaagcctcccagtgatctggtcaggtccctattattatccttattttacagaataataaacgaaggcacagggaatgggacccacttttctaaggacattaattactttctaatggaactgggtttcaaatttatttcaatctaactctaaagctcattccatttctactaaaataggcttcctgaaaccatctcagaagaaaagtccaggccaggcacaatggctcaagcctgtaatcctaacactttgggaggccaaggggcaaggatgacttgagcccagaagttcaagaccagcctgggcaacaaagtgagaccccatctctacaaaaaatttttttaaacaatcagcagggcgtggtggcgtgcacttgcagtcccagctactctggaggctgaggtgggatgactgtgtaagcccaggaattagaggtttcagtgagctatggttgtgccattgcactcagtcaccctgggtgacagagaccttgtctaaaaaaaaaaaaaaaaaaaaaaaaaaaaaaaaaaaaaagtccacatttctatccctcatgattaaaaagataacaataaaaaggctttatgacataaatcagatattccctatatgggtgtgcagtacaaataaataaaagctccagtgaggagctaagagcaaaggaccgtgaacaataaccatgaacaacatgggccccaaaacagacgtgacactccagtgagggcaggtggtccagatggcaccacaagaacaaaggcctgacatctctgaccagcacggaaagtgtttagaaaaaggaaggacgaccagtgacaaagtgctccaaataaagaaaattcatgaaaaatactaattacggaggaaaaggtgcttttgatacacttttaagtcaatttcatttgacgcctttgaaaatagaggggaagaaataaaaatgtattggaagccctgaggtatcttcacagcatcctcagatcagagaccataagacaaccaattcatcagaaaagacacatgacaagttaggggctatagggacaaaagatatgaccccagttctaaatttcattttctactagtgagaatagatttaaagtaaaacaccataggaaggaatgtgggaagaagtggctggaatttgtgccaaagctgctataaaaccagataaaaattccaggagatcctaagtttatgattttgctccaggggttcaaatcatggaactcctactgcaaggatgagagtttttttgtaaagggaaactgcaaaaaatattaaagatacctctgtccaactactgaaatcctaagtatatacaagttttttctataatagaaaagttacagatttaaagttacagtatttagataaatcataaatactacggatatgaatatttttaacagtaaatctaacatacaatataaatttaaaatggaaagataaaccaaatacataatatttgaccaactaaaacattcgcatgaataagaaaaaacatcttaagaaactcactgagttcataatcaagtgccattatgtgaaaaatggctagtgctgaatggcagtaatgtgatttgagtgggtctcaacctttttctgacatatgtgggaaacatgtcatgtcccatctgtaccagcccctgaactccagccatgatttccaaaacaggagtggaaggaagtacccagttctccccacctactacctctttaaagtcacagaaggcagaacgtctttagagctacataaagagaaatttgaatgctggttgtaacgcttgctaattttatgacaagttacctggccaccttgactgttagcttcctgatctaataaatcggtataagggatgcaacaccaatgtctgttacacaagatttattgagattatggatgtattagaaaatctcagaaagagactagtacagggcctatcctcctagtgctgggcaagtgtgtgctccaaaaatagttccctattctaggcacctagaggaggtagagctaatgaaagcagtgtcctttgcttgcatggtaactaagggagattagataggatgtgggtaaatactaaataaagtagccaatttttctggattctgctcctcttggtggacagaaaacttccagagaccaagagatatgatagagaatatggctcacctctactttctaaggtttaattacatatgaaaagcttggaaatgcattgttttaataattgttttgatgacgtataatatagtatcagaaacaaacaacataccagtaaacattatcaatcatgtgtattatcaatcaacatcataatgcactgataacaaaaaacataatgagatatatccagattccttttttatgatatccctaaccagggttgagaagtcccagagagtaaggaagtgaatgggtgggaagaggggaaagggttattggtggatgggcccttatatttcttttaagacaattttatttaccaagtctgaccagggtataaacttcataaatatagtagtcaatatcaataattaatgattcttaaatgattctggctgctcctcaagcagccattccgcctcctgcactgagaagagcaatgtcattcatcagcacagccccatcctccttgtcattggtcaaatgattggttcagggatgatgcaagccaatctgtgcctggcactccccttgttccagtgattgattctgcagaatacaggtgacataaggtggactaatcaaagtcatatccagaactgtcaaaggttcggtgaagtccttttagatggcaaataacatcatgtgatgcctcagacagttttgctgagagacccaaagaaaatcacagcccaagatagaccattaacatgagcacaaaaatggactcagtgcactgaaggcaggcaattcttcctcatgagagggtttcctaagctccgtgggatgttcggctccacctgcagcccagtaagtatcagaggcacgccccggttaattgcggcaacacaaaagtaactccacatgtttccaaatgtcccttgcctgggaagtttcttctgcacctttgagaactatcactaaatctagtattccctaactttagcaaaccaaccaacctgtcctcacaccctcctgcgattactaccccatttttctatatagaaattttcattgagaatttcttatcaccctggtctccatttctttattttatactcttccgtgagccaacacttgaagactgctcttggtaaagcaatgagctctacacttcaatcctgtcatcacatttcagttcttatcaggttgaccttccagggacattcaatatagttggcttctgttctcatcatcctttcttctcttggcacccgccagagaaacccttctggtttcccctacaaaagaggacatacttttgtagcttcctcttctggattctctccctttattggccctgcagattttggagcatcccaggagtctgaatctgtgtattctcccaggtgacctcctctaatcccgtggctgtaatgcaatggatatgtcatcaactcccaaatccttatttccagacttgccatctccctggacctttctttctctttctctttctttctcttcctccctccctccctccttcccttcctccctccctcctttatttctttcttttcctctctctctctctcccttcctctctctctctctctctcatctcactctgtctcccactatagagtgcagtggcacgatctcagctcactgcaacctccgcctcgcaggttcaagcaattctcctgcctcagcctcccgagtacctgcgattacagatgcccaccaccacacccagcaatttttgtatttttagtagagaaggggtttcctcatgttggccaggctggtctcgaactcctgacctcaggtgatcaattcgcctcagcctccctaagtgctggtattacaggcatgagccaccacacctggccctcactggaacttcagataattgcatctactagcatttgatatctacacggatgtccagtagataaataaaataaacattctcttcctacacctgtcttagtgctttgccttattcctaccctctttgatccatcaataaattttgttaacggtagtccttcatttctaacctaatctcatctacagcaatctatttccctacccaataatttgtggtggaacacaaatctctagaactgcatctttggactcatagctcaatgttaagtgaccttgcatgtgcaatttcatcttcattgggttgttataaggatctgcattattactagctacaagcatttttatagctcgttttttattttttaattgctatttttatgttttatattttattatttatttttatttttataactattacctgcatactcatttagcacttgagtatatgctgtatgataccatcctctagtagcttgtttcataattctttatttctgtctttgaagatctttgtgacaggaagcctcatttcatctccccacttatacatagaggccaggatttttgccttttataatgaattattaaatgctatcggatcaaccctcctgcaaaaaaactactataaaattgggacttcactaaagaaagcagattcttgaaaagccatagaagagtgaacaaaaaaaatgaagatttctagttagggggtccacatcaggagaagtacagttacgtaaagggagtgcccattctcacagctttaggcttgaagccaggtgcagtccgtgcacatggcatgtgggccagcaggcactttggttgcaaagccacagtttttctggctgaagaagcaaaacaccaagactgggacacctgcctccgaggagacacagaagaaaatgagtcagaaagagaaacccaaatttctatctatccacgtctctggctaacccctgaatgatgaaggtgcgttatcagactcaaagttgctcagctaaaggaaggatgtgctcaaggaggtgaagtataatgcccctgtgacagtaaatcccctgtgaatgtaaacgcccctatgactgtaaatgcccctttgagtgtaacacccctgtgaatatgaacgcccgtgaatgtaaacgcccctgtgattgtaatccccctgtgaatgtaaacgcccctgtgattgtaatccccctgtgaatgtaaacgcccctatgattgtaacacccctgtgattgtcttcctcctgaagaatacagcatggaaaggggaacaaaaacaacctcacagtggagaaacctgacaggcgctaccgcagccaggtgatcaaggtcaacatcaacagtggtaagtcatcttgatcatgtttacccttgacacagtgtgatgcaatgggcaatttatctctgtgggctttctctcaaaaacacataagcccagtctaatcttcacgaaaacatcgcacaaaacgcaattgagggacgttgtaaaaaacacctggccagcactgcgcaaacctttcaaggtcatccaaaacaagaacagtctttagaaactgttagagtctaagggcctaaggagatgagtaaatgcaatgtggtagcctggatggaatcctggaaaagaaaagagacattcggtaaaactaagaatatccaaatacagtttgaattttagttaataagaatgtatcagcattctttcattaatgataacagatgtagtataacaatgtaagaagtttaaaatagggaaactgggtgtggggtacatgggaactccctgtactatttttgcatctttttctgtaaaactaaaactgttgtaaaataaatgttcatatatattaaagaaaaagatctagatggagatcagacttgcacacaaagaacagattttcttttcaagatcaaccaaaataaatgtcttccaaaacaaacaaacaaagaaccaagggtcactggagaaaaaattacagaattcagtgtctccagtaattacgtttataatgtctgcgatataattttaaaagtatctaacatttcaaagaaccatgaaagtaaaccattctcggagaaaagaaaatcaagtgagacaaaaccctgaaatgactctaattttgaaactaggaaacaaaattttaaaggagctagtagtattactgtccttaaaggagtaaaaaaaaaaaaaaaaaaattgcaatgagtggaaagatatgacagataatcagagaaatagaaattataaaaaggaatcaggccgggcatggtggctcactcctagcaattttttgggaggcccacacgggcagatcacttgagcccaggagtttgagatcaacctgagcaatacagtgagaccttagctctattttaaaaaaaagaaaaaaagagagagagagagaatcaaatagaaattctagaactaaaactacaattgcctggaataaaaatctgttaaataaatttaatacccaaatggagattaaagaggaaagcattagtgaagaataaagaattgtttttaaatgaatagatgttagggacatattagataatatcaaatgatctaatatatatgttgttggagtcacaaagaaaaaatgaaagaatggggcagaaaaatttttcaaaaaataatgccctcaaattttaatatgtgatgaaataaataaatttacatattcaagatgttcaacaaatgtcaagcaggataaatatgaacgtgcttgtgtcaaggcaaatcatagcatagtcaaactatggaaagccaaagacaaggaacaagctttgaaaacaacaagaaaagtttgtctgtcacatacagggttaaaatgatgtaattaagggttaacttctggtcagaaacaatggagtccagaagtgacggcacaatattacagttcaggaagaaaacaaaaagcaaaaaatgcttgtcaatgcagaagtttatatccagtgaaaatatcttttaaaaatgagaataaaataaagatattttaagattaaataaaattaagataatttatcacaagcagactcatatcacaagaaatatcaaataaactcttcaggctgaagtgaaatggtacaagacagagattcaaatccacaagaaacagtaaaagcatcataagtgctaaatacagaagataattaggtaggaatttttttgctttattcaacataatttatttaatgcagatgactgggtaaagcagaaattctattccatggggagtttagaacatataatatgtatgccaagtatggcataataggtgcggggtaaatatgggtcttttatttattttatgaagtggagcaatattaacaatgaagaaactaagaagttaaggacagacattatatttcttatagtaaaaatcaaaatgaataaaaatattgacccaaaaagcaagcaaaaatcataatggaattccaaaaaatattgaaataatccttccaaaaagggcaggagataatgaagaatggaagaaaaatagagaggtagatagaaaaatacaataaactggtgaccagaactcaccacatcaataattacattaaattttaatgaagtaaacactccaattaaaaggcagggactacgtggacagagggaagtgggtccagctatactctgtctacagggctgcattttagatataaagacacaaatggtttcaaaataaatgaataaaaaatacgccaagtaaaatgtaatcataagaaggcagggatgacaatattattaatatcacaaaaaatagattcaaaggcaaaactattttgaaaaaacaaaaagagagaaacttaagactatgctgccaccacttgaaaaggtggatcgcaaggctcaagaatcatagcccaagccttcccactccttccctccttgaggtggaagaggtgcccggtactgcatcgggccagactgggaatgtcaaggtctcctgccacttccaggttccccggctggaaacagaatgaggacttcctaccctcctcagggagtaagagaccctggtcttagaacatagcaactgatgaggacatcgcgcatagcctcaaggaaacagctttggttctttgacgagggtgtatctccagtagaattccctcctctctctctttttccttctctctctccccaacatactctttttttattctttgattaattcttccacttttaaaattatttagtagaaaccacattaagggagatggagaatgagaggtaggaaaaaggcaactgaaaatctatataataagacgtgtatactgtggctaagaccatggatgttagaaccctctgtgtgggttcacagactagctctgtcccatcctaaccaactatgtaagcatgtcacacagtttctctctctcaatttattaccaacaaaataggcaataataatagtatctggccagacacggtggctcacacctgtaatcccagaagtttgggaggctgaagtgggcagatcacctgaggtcaggagttcgagaccagcctggccaacatggtgaaaccccatctctactaaaaatatcaaaattagctgggcgtggtggcgcacacctgtaatcccagctactcaggaggctgagacaggagaatcacatgaacccaggaggtggaggttgcagtgaactgagatcgcgccatggcactccagcctgggcgacaagagtgagactgtgtctccaaaaaaaaacgatgagaaagtggacataataataagggcaaaactctttggggaaggagatgacaaagaaaggagaagaaagactggatgataactagagagggtttgtgtcttataaggtatacgttctcagtatactttgtacctcatcaaaaataataatcatagtatctacctcctaaagttgttgtgagaatttaataaatcaatataagaaaggtatttagaagagtgcctaggcacattttaagtttcagcaattattgactcttaacttcaggtccaacatatagtgtaaaaattattgtaattatcacgtcagttgtgccatattaatgtttggttttaaaaatgtaccatttattttctttaaataagaaaagtgttcccaatggagctctattccactacactttatagtaaattgtaattggtctaaagtgtcgttagtatactgatagtgatatcttctgtttaaatagagctctcaattttcaaagtgcttttacagacattatctcagttaatcttcacaatagcactgaaagataattgggagaccatttactattcctatttttaaaataaagaaacagatgcacaaagaataaaagtggcttgcccaaacttcacaaggaaagaagcaggaaaaagaatcttgggtcctaaactccctcctctgtgtcagtggctttcacactggactgtatgttaccctgagggtatatgggacgtgccaatggaaagttctcctattcctcacacaccgttccttcaaacagatatgtctggaaacacatttatggctgtttcatgatggatcattttgtcccagcttcccttcgaaatcaacattctcccacttcacaaaacaaaggaatacactcaatctcccccacggtggctctggtgcaccaccacagggtgttaaaggagcatgccttgaacaactgggaacggggagcctcttttaacccaacccgttaactcacagtagagctttatttctttcagagtaaggtaaaggttggcattaggaacgatgatgtattttttagccatttcggactgtgttttcagcacgtgggttgagttaggctggtatgaatacagatacacagtaaagagggacaagagagatggtgatgttcatttaactctcatagctcttctaccccttggtattgccaaagaagtaattcctcctcagggaagttctcagaagatcagagctaagattgttgtctataatactgaagatgacggtatcttatatcacccaggagacaaactgctggcaaagttccatctcttacctaaccatccatctgtccatctgcccattcatccacacatccacatagccagccatccacccatccatccacctactcctctgtagtatagttatgcgttttgagaaatgcatccttaggcaatttcatcattgtgcaaacatcatggagtgtatttatgcaaacctagattatatagcctattacacacctaggctatatgatatagtatattgccccaaggcaacgtgtacagcatgctactgcactgaatactgtaggcaattataatacagtagtgtttgtgtctctaagcatagcaaaggtacagtaaaaatatggtactataatcttaagggaccaccatcatatatgtggtccctcattgactgaaatgttactatgtggtgcttgacagatataagatggctatgggggcccatttttttctgaaaaattaactcctattggctgtctgatttgaaaaagattggttttacatcatgtcaaaaggcggtcactttccacaaatggaatatgcagctccaaggttttgatttaaaaaatgttaaataaaataattttattataaatattgtattgacaaaagtgtattaaactgaagaacatttcaatttttcccaatgtttcaaaatttgtcagattgaacaaaatacctctaaatgatagaatggcaagaaaaattaagtgagttaaaaaaaactttataaaatatatttgatacatttcctagaaattgaataggtgaatgtctctatataattttgtccaagtaattagcttcaaattctttattttcaacaaaattaaagatggattcaattgggttataaattgacagatcactggagtaattatgacaaatattactaataaatttttgttacaattttgaagacattaaaagaatgaagttgctataataaaatctcttctattccaataaacttattagttagaacacgggcttacacccataacaatgaaaaggaagaacaaaatgatgctgaatccatttcattccagcaataagtaagattcatccacagacaggttaccatgcataaaaataagcccattcatctaattaagggatttatttctaatatttttatgcttagtaattatttgtcaaaaataccaagaaaccattcacccaaatatatatttatatttttaagtgatttgtatactaaaaatagcatgacacatcatgattcactagaaattaatactaaggcttatggtacaagagaatttaaaaatatatcataaactttaattcttatacatgtttttgttgcaaagatatattttgagatgatgtgtaaagatatttaaaacaaaaaatagttgattcttgttattttctataggctatagttgtagtctgtaaagtcaccacgaacagtaaactgctgaatactaaagcattgttcctaggggaaaaatacagggttaggttcctttgagcctctggttacaacattttcatccaccagtcaatacataaccttgttttatgtgtgtttctgtttaaagacagcttgtttattacattttattgattcattaacattgcactcatagccaatatcactataactaatgccttaactaggtttctataatgtgtatttctccacaacggacatcaccacctacttaaactcaggaacactagccagtacttcagtactatgcttggggccatttcgaacaatgaaatcaccaataaaaagcaccaaaatatgaaaaacatgacactacatagacctcaaagagggcatttgtttgcagtacgaaagttgaaacaagaaagcagaacactcaacctcaactgagaacatgcttattgagcaactcaaatcttcacaactctgccatttctgtgaatgaccttaaaagcttccagtactgattttggggcaaggaataattttaccatgttggtgaatttgcaaatatggaacccgtgaaaaatgaagattaactatattacattgggataaagttatgcaggagagtagaatagaaatgaaaaagtttgtaaaaaagaaacaatatcaaatttcagactattaaaaatcatcttttacatgtattattagcaagatgatactgaagggtaaatcatcagttttaatatcccccaaaaacatttttaaaatgatgcaattgctgtataatttaaccttaatatttataatctgaccatactgcaactacttaaacctataataaaatttttatatcaacttaaaaatgtgcaaggaagtatatggtttctcaaggtgttttataatacatatgagcaaaataatttcaagattactaactttagaaatagaagctaaaatcacaatgaggctgattaatacaaacaaagaaataaaaactacacaaaatcccaaacttaagagtcaggcgttgaaaccaaatagccattcagtgatgcagacacaaactctggggctcacactgtaatgagtgtgttgtgtttgtcttattaataatgatgaagtatttttttataaatactgctttgctcatttttatatagacaattttcaaacaattttatatttctcagttgcttcaatcaaaaagaggtttgtggccgggcgtggtggctctcatctgtaatcccagcactttgggaggccgaggtgggcagatcacttgaggtgaggaattacagccagtctggccaacatgacaaaaccccgtctctaataaaaacacaaaaattaggctgggtgcagtggctcgtgcctgtaatccaagctctttgagaggctgaggtgggtggatcacgaggtcaggagtttgagaccagcctggccaacacggttaaacccagtctctactaaaattacaaaaattagccaggcgtggtggcacacacctgtaatccccagctacttaggaggctgagacagggagaattgcttgaacctgggaggtagaggttgcagtgagccaagatcgctccactgcactccagcctgggtgatagagtgagactctatctcaaaaaaaaaaaaaaaaaaaaattacctgggtgtggtggcacgtgcctgtaatcccagctactcaggagtctgagacaggagaatcacttgaacccaggaagcagaggttgcagtaagccaagatcgcaccactgcactccagtctgggtgataagagcgagactccatctcaaaaaaaaaaaaaaaaaattttttttaaattaatagaggtttgtaagaatatctaagaaaaatatttcctcagacaggagcattactttaaggaaaagatagtactatataaatatattccactgttaaatatttccagtacgtgtcttttcctcccagagatgggacagcttgctggctctgtgagtaaaattaattagtcctagctttttgttgcctttttttttttttttcccagtggcagcttgtaactttatctcttttttttaaatatccataaattttccatgcaacaataggataaatttatttcactaattttaggataaagaaaatgaataaaattaaatgacttatattgagtaaaataaaagaagaggaagaaataaatgtttttgttttgtttttaagacagggtctcactctgtcactaaggctggagtatagttgcatgacatcggctcactgcatgcaacctctgcctcccaggctcaagggattctcctgccccagcctcccgagtagctgggactacaggcatgcaccaccacacctggctaatttttgtttttttagtacagacgggattcgccttgttggccaggcaggacttcaactcctgaccccaggtgatccaccctccttggcctcccaaagtgctgggattacaggcatgagccaccgtgcctggccagaaataaacgtttttattgtgagccaacagaaattactgattcatgcattaaaaatattgaagcagatacagtccaaaggcagcatcatattactgtagagatactacatgcaatctgcttggaagactgtgcatagtaagcacttattaggtagataatggcactcccctgaactgaaaacagaagttataaataatatttaaaatccaaaaacatgatggtactaatattagtacaagaaattaccaccttatatcttatattaacttagcaaaaattattaattaatatttaatgaaattgtcagttagatggtcagtaaaaggaagtctttggcccacagatcaaaattcacaatacaattttatccttaatctttaaatacaaaattacatttacgagcgtatttttaacttcgcagcagagatttaagccagtggcaaatacagaggctctcaagccagactacctcagtttaaatgtctgcttctcaactttcttgctttaataccttcaaaagtaaaatactgttcacatgtatcttacagagttgttataagtatgaaatgtctgactacatgtaaaattcttagattaatgcatagtatacagtaagcactcagtaaatgttagcagctactaaataaaaagtagccgcattttcaaaaatgattcggaactttctagtaatcaccaacattactttcagaagctctagttggaaatatttgttaaaatcttctcttaaaatctcaacagatagggagaaggtggaatctcacacactgcaggtgggaatgtaaaatgctaccgccactttggaaaacagtccagcaatccctcaaatgctcaaacctagagttatcatatgatcctgcaattctactcctaggctatatacttgatagaaatgaaaaatatgtccaaataaaaacttgcacatgaatgtccctatcagcattattattaatagccaaaaggtggaaaccacccaaatgctcatcaattaaccaatgatatatgcatgtgtttgttgtatccatacattggaatattactcagcaatgaaaaaggatgaagtgctggttcataccacaacctgggtgaaccttgaaaacattgtactcagtgaaagaagccagtcataagatgttgtatgattccattgatattgaatgtctagagttggcaaatctatagacacagagagtgcattagtgattgcctaaggtggtggtggacagtgtttggggagaaacaggagttactgctaaagggaagtgggtttcttttgggagtgatgaaaatcaaaattgactgtggtgatggttacaaaactctgtgaatatactaacaaacaatgaattttagaatttaaatgggtgaattttatagtatgtgaattatatcttagtaaaactgtatctcctccgctgtccctccctaaaataaaaccaaccaaatctctgtatacccatcacttattaaagtacttggcaaaacactgtgacttagtacttttgggataagcggatgaatgaatgtgcattcacttcactttaaatgttttttcccctattttcatctattagagaaaactgtaatcatgagaagaaacttacaaaatttgtaaacatcatctttcacatttagagtttgtttttataatgtgacaaagtttttctgttaaatatctcacagttgctgtacctagaagtgctttaagaacctgaaatagtactaatggtatgaaaaaggtagacttatatttcaacctttaatatagaaaatataatttgctcaaattactcacactgttctaatttccatatgctctaaagtaagtatgaataagatttagacctaattgctggtgacattaaaattcattcaattcttactgtcaacaaatatttactgaataagtaactatttgctaggcacagtgctagaaagtgatattacaaaaatgaataacacagcctggtgacagagatattacaacagaattatgtacaagaatatgatacatgctatattagggcttgtgccatgcgtaccacaccaaatgttttaagaatgaagagaaaaaaaaggaggctgggtgtggtggctcacgcctgtaatcccagaactttaggaggccgaggcgggaggatcacttgaggtcaggagttggagaccagtctggccaacatggcaaaaccccatctctactaaaaatacaataattagctggacgtggtggcacacacctgtaataccagctactcaggaggctgaggcaagagaatcacttgaacctgggaggtggaggctgcagtgagctgagattgtgccactgcactccagcctggaggacagagttaaagtgtctcaaaaaaaaaaaaaaaaaaaaaaaaaaaaagaaagaaaaagaaaagaaaagaaaacaaaaaaagaagagaccagcactttgggaggccgaggtgggtggatcacttgaggtcaagagttcaagaccagcctggccaacatggtgaaatctcatctctattaaaaatacaaaaattagccaggtgtggtggtgcgttcctgtaaccccagctactcggggcggggggctgaggcaggagaatcgcttgaacttgggaggtggaggttgcagtgagccaagatcacgccactgcactgcagcctgggcgacaggctgagacttcgtctaaaaaaaaaaaaagagacaatgaagaagagtggctaaaagctggagtagttcaaaatatttcagagataagggaaaatataggaatgatagagaaaaataagtaggggatttccaggtagagatttgttttttattgctacaggttaaagacacagtttaggaattactcttttagacaacaacagtgtattttcattagccatgaggttgtcagtattataggatggaggtatttacagtagtgagcagagagcaggcagagtcttatataactgtgagaactctggagctgtcccatgaaacttttaacgagctaaattttctattttacaaaaggacaacgtaaataattcatctttcaatattaagacaacatgttaactaatcaaaaatatcctggctatcacaaaattcaaaaggaaaatgtcaaaatatctacatgtttatattttgaattgaaagatattctaaaagttgtttcatgattatgaactgcacaatggagaccaatgtttggttcacaaatgtgtgctgttaattagattgagagtgattgtatatggtttctcacaaaggcatcttgagttcaaccatgtaaattgatggaattatcaaaacatcagacctatttcatttcaacctggcttttataaccaaggtgtgtgtgtatgtgtatggtgtgtatacatgtgtggatgtgtgtggatgtgtgcgtacatgtatagtctcccccaatataaatgtgaggctacattttcaggttaagagggctaatgtgtatcttgccttctcatcacaaattgttctacaagtccatccataatgataattatatccttcaatagacggctgcttacttcccaaattttaaactgaacaaaaatattacggatccaccagataattttaaatctatctacttgaactgcaaaattaggagttgaatgaaaaccttacttagtgcagtatgtttaaaactcatctttggctaggtgcagtggctcacgtctgtaatcctaatagttttggaggccgaggtgggtgcatcacctgaggtcaggagttcgagaccagcctgggcaacatggcaacatcccatctctactaaaaatacaaaacttagctgggtgtggtagtgggcgactgaaagcccagctacttgggaggctgaggcgggaggttgcagtgagctgagatcgcaccattgcactcccacctgggtgacggagtgagactccgtctcaaaaaaaacaattaaaaattaaaaacgaaaaaaaaaccacgtcatctttgagcatgttagtacttgctttgatacaaagggtctgcttgagtttgtattaaatcatttaactctccttgtagtttcctctgttattaaatgatgagaatgttcctaacctattgcaaatgattacttaccatggaaatacaaccacaattatactcaagattattccaagcacaaagttttgcatggaatcactgtaacattaacactgtctaataagaaacaaaacccaaatctttctgttaggagattattctccatgggtctccggccttctgcaatcttacctcactacctctatgctggactagctttccaagggggtttgtataggaagcatccttataagacaaaggtagtgtcttcctctggatcaaagggcagaagtgcttcctgtctgtcataaaagattcgggttccctgagctccgggttcctctccttttaacacatcctgctgtgtgtgcaggtgtcacttcacattgccctgtggaaactggggcctggagatgttgacaatgtgactactgctatggggcaagtaataaactatccagctccctgacccaggaatctcatgtcttggggccaatgtttggttcacaagtgtgtgctgttaattagattgggcaccagctgagtgactgtatatgatttctcacaaaggcatctcgagttcaagattggcatccatgaaactgtgagcagcctgcaagagggataaagtctcagatacttcacagttcctgacactgtctatcatttccttgacttaggcattacattcttactctctgaagctgttattttgttgttgtttttggggacttaataagcacattttaaagataaaaataaagcttaaactgaaatcaaaataccagtctttattttattttaatcaaagactgccctgacctttttttgagatgagatcatgaggtgacgtttaagctttgtaaatgcttatacataacaagtactttcaacaaaaaattctaacaattcttgatgccttatatgccagcttagaagaaatcaatcattgtttactttttcacttaaatttgcagatgctgattaaaaggcgattactattttttttacacttaggtctttctttaatcaaaattgactatatctctataaatgggaatcagggatctgctattacacaaaaatagatgtcaacatatgaaaattaaataaatgaactttgccactgccctgtaattaagtgataaagatttcattcacttttctaaggttttaatcatttatgataacttttattttcttaaggaaaaattgaactttgattttaaaaattctaaagttttcctaaaatatagcactaatatgtaatggagcaaactttcaaagtcacattctatttcattagaaatttgtctacaaatggccgggcgcagtggctcatgcctgtaatcctagcactttgggaggccgaggcgtgtggatcacgaggtcaggagatcaagaccatcctggctaacacagtgataacccatctctactaaaaatacaaaaaaaaaaaaaaaaaaaattagccaggcgtggtggcgggcgcctgtagtcccagctattcaggaggctgaggcaggagaatggcgtgaacccagaaggcggagcttgcagtgagccgagatcgcgccactgcactccagcctgggcaacagagtgagattccgtctcaaaaaaaaaagaagaagaaaaaaagaaaaagaaagaaatttgtgtataaatacaagttttaagagccccccctcctccttcttaataaatattaatgcatttgctcctccactaaaaacactttaagaaaatcaacagccatggcgatctcatggctgtgatgtgctcagggcaagcatctatgtaacatatccctattctgcaacacctcacccagcagacagaatgtttacctaaaactccctgagcttatgaaaacttcaacaatcatgtcaacatttaagctcgttcccaattaaccagtcttaccaagcatcacttctatgaacattttaaagaaaaaccagtgaagtggtgaaatcaactctgtccaagcttgcatgcaactctaggaaggcggttagcttatctctcaactagttcttatattacaccactatatttaacatctgacttttgttgctgtttataatattaccctttattttccttcaattttagaacctcagtttgtggccacctacagaataaactttcagctttaccaaattttctcttcttatgagagatgcacaacacttaatagagagaacactatttttcaagctgcaatatactgtggtgttttcatgttagacataaatagtgtcagtgaaaatgttgatcaaagaaatgaaattctaataggatgtcagaagaagcagattaaacaaatgatctagctgttccaaagacatcaaaatgcaaaataattcttttctggaggtattacttagccaaatgtaatttctttagcaatttcaagaaagaataggaagtgttaatgttagtttaattatagaaataatgtcaagtgacaatggcagggaagaaactgaatgctgatttgatctacacacagtgacatggacatttagaaaatatattatatgataattatataatcctggctaaattctttgataggtttcagttgcccctgtaaatgttctaaaattaaattcaggagggtatattgtgatatttaagaatttaacaaagttatctcaagaacatctcacactctcatgctatctgcaatccttgaatatatggtgactaatatatcttaatgtatttttgtatatcaatattttatcatgttatttcttaagacgacaactccaaataacaaagtgttgaaagaaaatatcagaaccaccaatatttttctttccttgacatacttgcagatatatatttttatgtttataacagaagttaataaagaaacatgcccagcttattatttctggattgattgcagaaacagctactaccttttttgatgatgtggaagtttatgcatgtattgaggaggcaatagctgtgataaattacttcaagaaaataacactttccattgcctttctttttttccttacaacctgtgttatggagtgaaatgtacttggccttgtcttcaggaggcagaagcaatcatttgcagaataggctttgtgtgctaacatttaatattaatctattcccaggcattatattattaactttgaatagatgctgacaagtcttgtttttggagggaggtggggcagggtatcgctctgtcacccaggctgaagtgcagtgttgccatcatggctcactgcagccttgacctcccaggctcaagtaatcctcccacctcaccctcaagagtaagcaggacaataggcatgtgccactacacagggcaattttttttattcttgttttttttttagagacaggagtctcactatgttgcccaggctggtctcatatgcctgtgctcaaaggatcctcctgcatcggtctcccaaagtgctggaattacaggcatgagccaccacatccatttcacttttgctttttttttaatgtgccattgttgcatctgtttctactgaagaataaaacagataccactatgctctttgttttccttttttttttcttttaatcactacccatttattaaaggctaggtggatttgggtaattcatcactgctaagtaaggtaactaagagcacgtttatggatatattatatacactggttacctcgtttcaataaataagcagctggtaagtcatctcccagttttatccccaacttctaaaagaaaaataggtcgaaaaaattaacaaatctggttaggaaaaatacactgagcccaactattatgattccctggattctattattacgtttatttattagtattatgagtctttgctaaaatgttgacttcttatggaaggcctctcaacagtgctgtttaaaaatcacacgtaatcaatcctttcactcggcacaccctaacctttttcccttcttcctttttctccacagctttcatcaatatcaaacacaattcatcatgaaaatcaagatttattcgttttgttcactactctatccccaatgtctggcacatactagctgctcaataaataagaatgaatgtgtagtataccacatggatgaagtatgggaggtattcattcaagcacttatcatgcgctctcctaaattacttaacatcagtgactgcccccactccacccgctcctcatccagcctccactgaatgaggaaacagcaccatgaatgaatagctcatgataaaaatttagcgatcgtcatcagtgtatccctttatccctatcattgagcctttggttctatctccaaaatatttattagatttctctacctctctccatctgcattgtcgtgaccattatctgtcttttgaatcagagcaatactctcagaacaggactcccaaaggcagtcagaggaatcccttgacacaagaaaaaactcacgtcacttcctactttaaaggcctcaatggccttctattgttcacaggataaaatctacactccttactgcagcctacagggctgcacggcctggctcccacttgtcctccagcctcaaccccctgtcacgctcccgctacgccgcccaccgagctcccgctatgctgtgtctggaagaagccaaccccttgctggattttacaccttggtacttgttgttccctttgcctggagcactcttgcctcctatctttccatgactcattcacagcctctagagagtatctcaaatgccagctgcacaggtcttcctgtgaccaccctaattaagcagcctccctaactactctctcatcaccttgtttactgctaccgtggttcttatcaccactttgttaacttactctttgttaaatgtaagccccgacaggacagggactttgcctctgtatattcacagggactaataaaatacgtggaacatggaaattgctccatatataacaaccgaatcaataaatagaacattctccctcacttgggtggcatccctcgtctcactaattagaatgcctgacacagaagagacatgctacaaatgttgaagtgaatgagaaaactgaaatcttttattgtatcctgagtggcacccagaaagatctttgttcattaatatttgcatataataactggactgagagaaaaatgaattcatttgattgacatttactcagtgtctgtccagtgctggaaagagcatatggcaatttggcttgcaagcacagaacagaggatatcatttctaaactgttcggtaatcccataaatataggacacacacatttcaccaaggcatttggcaaagtttctcattatatcttgtctttaacatgcaggaatgcagattggatggtagcccagctgatgggtttggtactagagagtggttagatgaagacagcttaagcatgttcaacagctctttcaatgcagcaaatatttcttgagcagctccggccagccaagtactgagcttgaggctagagtaataaaataattaagtgtggtctcttacctagaagggtgcataagtcttcccgtaaaacatttcagatctctgccctgtaccattgacattatttttaaattaatatattggatggatatatacagaatgtacttctatcaaaatcatatgagaattttaggggaaaaaacagaagaaataataaatcaggatccaagagatgataggtatctcaaaggctggaatgaattctttaaattaaatttagtgcagatatgaggtcctaccaatgaatccaaaataccaactacatatttacaaaatgggggaaatatggaatgtatccactcataaacattccttagggattttaatttacagtactctataaaaatctattgtgatatagtgatcacagaaactagtttcaccttctggtgtatttacaaggaagtaatcagcctgtgctcagaccacacttaagactactgtgtttgaaggcacgcaccacactataagaaaagttcagaggaggcggtcgagatggacacgaggatccttgctgcaacagccaatggtgttgctaaaacactgacactaatgaagaatttgtggaatgttaagaaagtgggggggttgcaggggggggtgggtgacagaggaagtcattctacaaaaaggtacttgcagatgcatgtttatagcagcacagttccaggttgcaaaaatgcggaaccagcccaaatgcccatcaatcaatgagtggatcaagaaactgtggtatgtgtgtgtgtgtgtatacacacacacacacacacacatacacatactactcagccattaaaaggaatgaattaatggcatttgcagcaacctggatgggaatggagatgattcttctaagtgaagtaactcaggaatggcaaaccaaatatcgtatgttctcactcataagtgggagctaagccatgaagatgcaaaggcctaagaatgacacagtggactctggggactcaacaggaaaggatgggaagggggtgagggataaaagactacaaattgggttcagtgtatactgcttggatgatgggttcaccaaaatctcacaaatcgctactaaagaacttacacatgtagccaaatatcacctgttccccaaaaacctatggaaataaaaaatttaaaaaaagaaagtgtgggtgaatggtagagaaggagggagctaactgtccataagtattcaaagagcaggtatgcagaagaaatagtaaacctgttttacacgatcctagggcacaggactaggaaactacatgaggacagattttgattcaccataaaaaggcctgactatcagtgctgtcctgcgaaagtgaagcatctcgtgaggaagtcagctctctatcaatgacaggtctcccacggccactgggacatcctctggacaaagacatcagactcaggacttaaacgctgcatagacagcagatttctagaccctatgtccttgacattttatgatataatgaaaagggaactaaaaaataaggaagtatacattttcattcactcaaccaatgcttgctatggctaggcgctgttttaggcaccgtggacacagcagctaacttaggcaaagtaatcccagcattttgggaggctgaggcaggcagatcacgaggtcaggagttcaagaccagcctggccaacacagtgaaaccccgcctccactactagtacaacaattagccaggcgtggtggcaggcgctacttgggaagctgaggcaggagaatcgcttgaacccgggaggcggaggttgcagtgagccaagattgcattactgcactccagcctaggcaacactgcgaaactctgtctcaaaaaaaagtatgcttgtgaagcatacattctagatggtttgggacaaaatgaaacacaagcataaaacaccaatctttgggtttgagaggatacttggtgctagtttgaggcaaagctacacctgaggcattcacactttaattttgtttatttatttttaaattttatttatttgtttttttgagatggagtctcattctgtggcccaggctggaatgcagtggtgcaatctcggctcactgcaaactccagctcccagtttcaagtcattctcctgcctcagtctcctgagtaactggtattacaggtgtgcgccaccatgcctaatttctgtatttttagtagagatggggtggggcggtttcaccatgttggccagaatggtctcaaactcctgaccttaggtgatcggccagcctcggctacccaaagtgctgggattacaggcatgacccaccacgcccagcccacactctattttttatttatttatttattttcatttttatttatttatttatttattgacagagttttgcttgtcacccaggctggagtgcagtggcacaatcttggctcaccgcaacatccacctcccgggttcaagcgattctcctgcctcagcctcctgagtagctgggattacagtcacctgccaccgctcccggctaatttttgtatttttagtagagatgggttttcaccatgttggccaggctggtctcgaactcctgacctcaggtgattcacctgcctcagccttccaaagtgctgggattacaggcgtgagccactgtacctcgcctccacactttatttttaagctggaagttatcatagatagagccatttgttacaataactgcagtagaccttttgcctttattcccgctatatgttctcctttcctttctaacctgtggcttccactcctcaccactgcaaaacaatttacaattaattgcttatactgcaattattaataaaatatattttgccatttactaaactattagatatgttttctgagtttttacacattaaaactttccacagtaaacattataagtgttcattattagaattcataaattatacagaagtgcaaaaactaaaggatgtatctacttctgttactttcacagaataatctatgcatatgtactaatacagatttagacatatgttatcccaaatctggtagtacttttgtagcttttcattttattctagtactaaaattattagaacactagtctttttggaattgatttttaaagtcccctaattggaattgcagccatctttttggtctgtcctccgattgaagaagatctaacagtgcaatcatcatatgacacttaataagcatccttgctgggcacctggtccataagaacattgagaataaatactttcctgacattcagtcagattgattgatgcacatcaagtcaatgacactggggaacgctttgtggatggaatgactacataataacaggaaaactctaggaagatacacttaatgaatccttattgatctaaatacacctaaaacttgtttgtaactttaacctctgccacattatagaggaagacattccaaactcaaactttttttttatatactttaagttctagggtacatgggcacaacatgcaggtttgttacatatgtatacatgtgccatgtgggtgtgctgcccccattaactcatcatttacattaggtatatctcctaatgctacccctccccccaccccccaccccaagacaggtgtgatgttccccactctgtgtccaagtgttctcattgttcaattcccacctatgagtgagaacatgcagtccaaactctaacttttattttattttattttattttattttattttattttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttttttgtatttttagtagagacggggtttcaccttgttagccaggatggtctcgatctcctgacctcatgatccacccgccttggcctcccaaagtgctgggattacaggtgtgagccaccgcgcccggccccaaacttttattttatatatatatatcttagtagaagttgaacaaatatttccgaagctgttcagaacaaggtagaattcaacatactggaaatgtgtgtgtggcctgaaaattatagccagctactccagaaacctatagttgtggtgttttggaatttggtgacttggccatggttattcaattaaggaaaatattctcatacttatttttatatcagtctttcctactcaggtccttcaaagaaaacatggttaaacctattctctccccttcatagttgcttaattttattttttccaacccaggaagtcctaacttgtacaagtgtatcctcataaaatactaatgccttggtcatgttatctactctgaagtcattttaagcctttccctttgctaggatgcttaccacaactggatatttcaagtatggaagcaccatgatgtgaagcaaagatgggaaagtagttttatttctgtttgcaaacaaatgatgtctccttcttcactggtattttaggtaaaggcattaggaaaaactactggcttcagagaagaggacttaatgacactaagttgtgtgatctggtgaacacactttgaatcagttttgtccaaatgcatttccctatgtttgccaacatcaagctccctattataacatagtttctagaacagtgctgcccaatagaaggactagtaaagccaccgatgtgggccacatataaaattttaaattttctggtggccatgataaaaaagtaaaaatatgcagatataattttaatattttatgtagatgcaaaatattatgatttcaacaaataatcaatataggaggtattaataagatagtggtcattctttttttgtaccaagtttttgaaattgggtgtatgttttgtaattacagcacaactcagttgggactgtccatatgtggctaacggctactatattggcagacaattctagaaccaagctgaaaaccataaactgatggcaagtgtggaaagagcacagtttgcactctcagactactagattacctagactctttactcttgaaacatcaaatatgaattcatctattaaaaatgtcaccataattatagatgtaggttagcctttcttttacaatgatggggtaaaaataactgatttcccaccagctttccggtgcaacatccattaccataataaagcaaatttaaatttaattagaatgtaattaaaggtaatgtgggtgattccaggatagctgatttgttttactagtaacagaaacgccctttgccacttatatgaagctggaacaatattaatcaaatgacttattatctgagagaacaaagtacagaaatatttacataacatagtaccataggcagaatatccacgttaaactaatgttaagaacgacaaagggaagatacgccagcataatacatcttacttcttttccaataatacaactgggacattgcaaatacccaacttctagaatctgtcaggaagagtaatctacatgtatttaattctctcctgcacatgttgaatgactaaattgtgaaaatatatttgaatgcttttttttagaaatcactatacttctttgttaggttacttaatttttagcataaacccaccaaatcccatgtcaattgttaaaaatggatctattcaagcctacagtataaatttatggtttcccaggaaatcacaggaaagttgttgtaaaaggtattaaaattattgccaataaatcccatgtttaaaaatattctattaaatgtaaatgttgaaagtagtattaataacagctatgttcaaagaaaactttaagggcaaacataaaacaatttacttggaaggccatattacaagattcaaagatttgctagattctttgaacaggtttcgatgggagatgatgatcttgtgatctgtagataagagactctgaatatcaagtgatcagaaaccaaagcagagataaggctactgaaaatagcctatttcctgtgctggtctggacctaggctttggggtataggcaggcctgataccagaagtccgatgtagcaaaaggaatgaaggaaaaagatgaagagacaaaaacatgctgacactgtcattatttctacaaatgtcaaaataaaattcaaaatgaaatcgattttttaattataaaaattcttctgagaattgtttattttcccctccagacataagtaaacttaaggcaaggaatcatatttaccttctgatatgcttcacatagaatttgccactttttatcagcaatattaaaaatgattatgtgatgaatagctttcagtctatacgccctgagagcaggcaagaaaaattattcaaaaaaacaaaatgcttctcactattaaccaaaaaacagcctatgaaaaggcacagtcaaatgatcttggtcaacaaggctaaggcacccattcattatttattgagggcttattgggtataaggacatctaagaattattcaacgtcaagtgttgtgggccaaaagccacaagagaaaaggattttcacttccaagtccagcctaatagttccaatcttggaaagaacgagagaaataacagaggaagagaaaagaaagagaaacttggaggaggaacaaataaacagcagacatgttgttactggagaagacaaaaaatgcagtgagaagatagagacgtaagaaccgcgcaggtacatgcatgtatgcatgtgtgtgcatgtgtatgcatgtgagtgtgtgtgtgcatgagtgtgtgtgtgtttgcatgagtgtgcatgtgagtgtacgtgtgcaaatcaagagacacaagcacagggctgcgtgtgcaatgcggctagctgcgtcatgcctccggaagtacaaaacaccactatttatttatttacgcctctggaagtacaaaacagcactatttatctatttatgtattttgagacggagtctcgctttgtcgcaatctcagctcactgcagtggcgcaatctcagctcactgcaacctccgcctcccgggctcaagtgattctcctgcctcagcctcccaagtagctgggattacaggcgcacaccaccatgcccagctaatttttgtatttttagtagagacagggtttcaccatgttggacaggatggtcttgttctcacctcgtgagccgcctgccttggcctcccaaagtgctgggattacaggcgtgagccaccgcacctggcctaacaccactctttttttttttttttttgagacggagtttcactcttgtttcccaggttggagtgcaatggcacgatctcagctcactgcaacctccgcctctcggtttcaaacgattctcctgcctcagcctcccgagtagctgggattacaggcatgtgccaccacgccctacttatttttatttatttatttatgtatttttagtagatacggggtttctccatgttggtcaggctgatctcaaactcccgacctcaggtgatccacccgcctcggcctcccaaagtgctgggattacaggtgtgagccaccgcgcccagcccactctttttgagggtagggttcacaactgtgtatatgtaaaatttttagtctcaagatttctttaaagtggtaaacagtcatgctgcagactcataaactgtgtaaattcatacaaaagtttagtaaatcttctcaatcccgtttgtataggctttcttaagtgaaacaaaggggcagaaataaacaataggtaatgataactgtggaaaagaaaacaggcagcacagcatgaggaaaggacgagcacagggaagcccaatgggtcagaatgatgtgcaagctcggtcttgcctggttcaacctcatgaacaagagaagatcagcaaacgtgataccccagccacaagagtaacactgataataataattacgattctatcgtcatcattcatgtggaggtgcatgccaggtgctttcgaattgttaaccacccacaagaagcctgaacacctagagttctcctcatcgtgtacataagcaaagggaagggagagagagtctttaattggccccagaatatacagcaataaatggaggagctgaggagtaaggccaactggttctgaaatcctgcctgtggtgtctggctgtaaaactctgactcttgcctaagctgaagtctagcctgggacctgaagtgcagcaactctgactgaagctggatggttactctacttccagtattgtgctcaatgaagaggtcagtttttgagcaaatacacttgactctttgagggagttaagaaaaatgaaattgaaataaagccagaatatacaccagagaaaattttggtgtctattttcctgaaatcacacaatctatcttaaaatttttacaatgctcaaaggtgtttcatcattgcccaccaacttctatcctggtaggtaccaggaaattatcatctctcaggtttcaaataaagcaggtataggccagctgttcttgctcacagtgatactacaggcagtcaaaaaataaattcgctgatgaatgttacctcctagaacttccacgcgtgggacttacacactgatgcacgagtttccattggcatttttgacagcatctatactcctcttatatcaacagaatatgtccagaactactggctttataagagtcgagttatgcagttgctacacagggtcattttgccagtcctttcattcaaaaccatctttggtgactcccttcattgagaacaagatgcaaagtcttcaggtgttcacagtcctttacgattccctttttccacctatttcttgctatactttcccctttcagtatccactcttttctcatcctcctcctctctgctgcggcctctcctacttcacaaacaccagccacagggagcttgtttctaggtcatgcttcatattctcctgcataactgcatgttctctgggataacctttcccctacagcatctctaactattcaggaagctaaccttgtggaaggtccattcaaattatacccgtcttacaaatcctgctctatctcttgctgttgtttggcaacactaggatcctttactgtttgtcagcctcatcctgtttcccggcttctgcaactgtttttctcagtacagtgcagagtcccagagtgcagggtcctaaagcgcagggtcctagagcacagggtcctagagcgcagagtcctagagcacagggcgaacatggttatccacggtgagatcttcttcccctagtacctaccacagtctcccatataggagacattcacatgtatttgtttaattttatgaacaactgtagagcttactctgagaaaagaggtttcatactgacctgtaattggatattctctttctggcctagtatataacctccctgattcaggctgcggctcagagttcttcaaagagtaagtacagttatcactgttgaaagtgactctggctgtaaacatcaaagacgtgatttctaatgttgttgtggctgaaactccgcttaaacactagggagaacaacaagtccacagaagtcacatgtctgttcattaaacgcacaggaagaccttgaactaaacccttcacaaaacatctaacacagagcttgcaatggtgaggagcctctctctcctgcacagccagtgaacaatctaggcttggagagacagagagaagagcaagagcattctaataagcaggtgtctgtgacctcctgagtaaccaaccgtgaaaccaagagataagtacagtcatgggtcactgaacaacgaggacacattttaagaattgcgttgttaggggattttgttttgggaacaccacggaagggacttacataaacccagatggtacaggcgactccacacctaggctctatggggcagcctgctgctcttggctacaaaccggcacaacatgtttactgaatgccttaggcaactgtaacacaacaagaaacatttgtatatataaacacaaaaaagtaaagtaaaaacacagtataaaaggtaaaaaatgggacactcgtctaggaaacatggagtttgcagaactggaagttgctctgggtgatcagggagcgagtggcgagtgaatgggaagacctaggacatgactgtccattaccacagacttcaccaacactgcacactcaggctacgctaaagttagaaaaaaacatttcctttcctctgtgataaattaactttagcttactgtaactttttttactttataaactttttaactttttgactcttttaataataccggtttaacacacaaatgtattgcacagctacacaaaagtattccttcttcatatccttactctatatgctgttttccaccttaaaaaaaaaaacaacctttaaaacttttttctttttttttgagacggtgtcatgctctgttgcccgggttggagtgcggtggtgtgatcttggctcactgaaacctctgtatcccaggttcaggagattctcctgcctcagtctcctgagtagctgggattacaggcgcatgccaacatccccagctaattttttttgtatttttagtagagatggggtttcaccatgttggccaggctggtcttgaactccgtatctcaggtgatttgcccacctaagcctcccaaactgctgggataacaggcttgagccaccatgcctggcctatctttaaaacatttttgttaaaaagcaagacataaacacacagtagcctgggcttagagagggtcaagatcatcaatatcactgtctcccacctccactcacatctggtcccactggagggtcttcagggacaataacaaacatagagctgtcatctcctgtgatcacaatgccttcttttggacacctgctgaaggacctgcctgaggctgttttacagttatctgtttttttttctcaaaaataattagtaggagccaggcgcagtggctcacgcctgtaatccagcactttgggaggtcgaggcaggcagatcacgaggtcaagagattgagaccatcctggccaacatagtgaaacctcgtctctactgaaaatacaaaaattcgctgggcgtggtggcgcatgcctgtaatctcagctacttgggaggctgaggcaggacaatcgcttaaacccgggaggtggaggttgcagtgggccaagattgtgccactgcactccagcctgggtgagagagcaagattttgtctcaaaaaaaaaaaaaatagtataagttctataaaataactataaatacacaaaccagtaatatggtcatttttctaatcacgtactatacataattgtatgtgctggacttttacacaattggtatcgtagtaggctcattgaccccagggtcaccacgcacacgaggaacgcattgtactaggatgttaccatggcgaagacatcactaggctataggagcttttcagctccatgacaatcttatgggaccacccttgcagatgtggtctgtcactaactgaaatgtcatggggcacatggctgtatacatttttttactgtatttgaatgatacggacaattactgacgaccaaaaatagggaggagaggaagaagatgacatggaagtaagtagaaactatttctgaaggagaaaaacttacatgggaaaaagactccttctttgtgccatggatttgccagttgacatgactgaaaagcagtcacccaaacaatgaccaggaggaccgagtgctgctggtgaagcccaccagagaccagcggacggggactgctgctgtgttagcgaggggaaaaacagcctaggacactgcccaccccatcttcaagggcttccctgactctagcaaatcataaaaaccaaaacccataaatgatgaggccaccaagtcataaagaagaagtcaaacccaatcattacccttttgttagatagtatggaaggagacagtgtattttaactgattctctttttttttaagacagagtcttgctctgtcacccagcctggagcgcagtggcacgatctcacctcactgcaccctccgcctcctgggttcaagtgattctcccgcctcagcctcctgagtacctggcactacaggtgtgcaccaccaagcccagctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttgacattctaccaacaagaaagactattttataaggctgcatattcaaaagttattttaaaagcctcattacatgtaagacaccatatggagcatgtcacaagataaacacatcagtactctcatataaaagtagattttggccaggcgtggtggctcatgcctgtaataccagcatattgggaggccgaggtgggtggatcacctgaggtcaggagttcaagaccagcctgaccaacatggtgaaatcccatctctactaaaaacacaaaaattagccgggcgtggtagtgcatacctgtaatcacagctactcgggaggctgaggcaggagaatcatttgaacctaggaggcagaggttgcagtgagccaagatcgcaccattgcactccagcctgggcaatagagtgagactctagtctcaaaaaaaaagaaaagaaaagtagattttaaggaaaaaaacgcataatcacctactaagaaggtctagaaagtgtgattaactctttaaaatctaataagatatgaactctacctccttgaccacccagtgtctaaagggttattcctggggtcagctttgcagaaagtgcttccttatggagtggttgttagttgactttgccagacagcctctgcgttttcattctctaacggaggctggcaagactttgtatagagatagaaacaccaattctagtttgttccttgagaaggaaggccaagtgactggttttctgaggctgtgtgtatctcccaggcacaagcctctgtccccaggagagcctgcacgcgtggcaggacacatttgtggtggggctttttacgctccctgtcatcactttttatgattttctcagtaattccttttctttactgaggaaatgaacacacataaaactggaaaaacgagcaaagaattacataaaatctacacaaggacttcctggcaaaaagcttcactaacataatagatttaagttcttacaatcagtggttcccaggcctttgaatttcatggaccagaattttttttttaagtgaagaattcaacatagaaacaactattatttgttctttaaaaacatttttgaaaacctcactcaaacaaataacctagcaaaactgttttataaaataacgcctggctgggtatgaggactcatgcctctaatcccaacactttgggaggccaaggtgggaggatcacttgaggccaagagttccagaccagcctgtgcaacaaagtgcgacccccatctctactttcaaaaaataataaaattaaattaaaataatgggtattttaacaccaaaaagaagagttttgcctagacagcctcccagacataagaacagacactacatccaccatttccctttttttttttttttttttttttttggcggagggttaaacactcactaatatttaggaattagtcctctgcaatttttcacttgtcctgataaaatccagattttacaaagtttaaacaccacaaaaatcacagggctgtctatagaaggaagaattcctgttactcttagctgaatattcccaataattctttgactttctttctttgtcttatcaaaccaatgagaatctccaggcatgcatgttttaggtcaaattaaggaaacgcccctatgcctgatcctatttggaatttccatttttactcatgtatgtcccacgacaataaaattattgaaaagcaagtgccaccagtgtggatgcatggtctccacaaatccactcttcactgaggagatttccccacatccactaaggtgtgggtcgcctccagctgcagcgccatacctcatgagatcagcagagctcaggctgaatagcattcctcctttcctcctctctactcacacttcctcagaggctatccagcatgataatgaagaacacaggtggtggggtcagacagccactgactacctctgtcactctggatgggtgaccgtcctctctgagtatcacttcctcctctgtaaatgagaacaatactgctcactgcatagggctgcttgtgtgagaacagcacgagcaggcccacatggtgttggaaaaggccccgacgcatagcaagggacaaatagtgctggtgattgacactagcccctgccaggctcttgggcattaggaatccatagtcaagcaatgaaagggtcctgccctcatggagtttacactctagcaggaaagacaaatatttaataatcatgcaaactgaaattagaactctgataggtgatactaagaagggggtaaaggtgttcctgaagcctggggtctgggtctgtctgtggagatccaggataagccaccactcctgaaactttaaagatgagtaggagttaacaatttggcacagggagaaaggagcaggggtccagggagaaggagctcacccttccttccttccttccttcctcttcctttttcctaaattgtaaatgtcacctactctaaataaggcagtgtcttaaagaacaacctaataatctatgtactggtataaaccttaaacaaagttcaaatttactccaatgcacaaaaattcagttaatctctatgaaacaatcaaggatggcattatattctagaattcttctgctggccctcctccaaagcgacatatgaaaagctgaagcagcatacatttagcttgtttcacagaagaatacttatcttctaagtgcacaaagtaaaacattagaaagggattcagtacagaatattaaaactctgtatttttcaactgcctgcactgaggaaagatagaaaatctatcccacaaaaaagtatgagtttggaccagtttgtttaaatttaacaaaacaaagttcatcatggctgatgaatcaatctttgttttgagtccctatttttacgcaaaaccgcactttgcccgacagcatgagctacttgtgaaataaacacttcaagcctcaaatttcaaaggagttataagtatgttgggggcagcaatgcaggaataactttcccaccccctggtcactatcaacttggagaaaaattatttccaatttgccttctactttgtacccttgtggtgtctcagatttcacagtccctgaaggatgtgctgtccgtgcactcacaaacaccccactctggccatctccactttgctacagatcacagtctctttgcttccagtaacttttctctatgttccagggtcacaacccctcctcattatccccaatttccttggggtaaatttctaagaagtgtctttataccttaaatccttgtttctttttaaagcaagaaaatgctggcatgaggtcagatgcaaatcactttgcatcctcaaagcaactaaatattgtcccattgtagagatgggatgtccttaccatagtgacagtgacagcatactctctcatggctccctgcagagtccttggaagcgatgtgacaggttttcataaagagggaagagaaaaggacttaaaacactgcctgcaggagcctctacacccttattactttctgggttattgcctcatgaggaaaaagaaattcaatcatttgtcggggggaaaaagtgtgctttttcttttcaaagtctacccttttatgaaatatttaagcaaacatttatttacttctaaaccaccaggaaaagaaagaaaagcaaccaacatttaacttcacagaagaaataaacatttcactaactgttatacctttaaatttgttttgatatacagaagatcatgaatacagtcatctatattttcctagtcagtgcaacaaaaaataacactcactaatagatcagaaaatggagatgacaacacttaattccagaatccaggaattttttcccatagtttcctgtaatccctttaagactctaaacaaagtattctaccttttttctttaagaaaacaaaacgaatttcatgcttatttgatatttctaataaatgattttaataatagactaagccaaaaaggaagctggtctatattcattaagaaaaatgcaaccataatcacatttcgtgaatggacaactttcacatatccacactctcaatgcctacaaagtttaaatggaaagatggatcgttcaggaaaagcgttgagagcagcatccagacctcagcactgccctcacactgagcccttcaaaaggacggcacgaggggccaggtgcagtggctcatgcctgtaatcccagcactttgggaagccaaggagggtggatcacttgaggccagaagctcgaggccaccctggccaacatggcaaaacctggtgtctactaaaaatacaaaaattagctgggcgtggaggctgaagcaggagaatcgcttgaacccaggaggcgggggttgtggtgatctcagatcgcagcactgcactccagcctgggtgacaagagtgaaactctgtctcagaaaaaaaaaaaaaaattagccaggtctggtgacacatgcctgtagtcccagctgctagggaggctgaggcacacgattcatttgaacccaggagatggaggctgcagtgagctgagattgcaccactgcactccagcctgggcaacagaatgagactctggctcaaaaaaaaaaaaaaaaaccaaccaaccaaggatggcaccagggaccactttgtagggtgtaaacaacaaattgctcagcataagaaccattttgaaaacacaatgaaggaaaacctgagatcaccatgcttcactgggtctccagggcccagacagaggtgacgcaccaggtgtgcgtgacgacgtcaccctacaacctttagtccaccttcatgctccagccactgcctgcagctgcgcccagacagcacctgactgcagttgccgtgcctcactcactttccgccttcatatgcctcatacactgccagctcgtgggacgcccatggagactgacttagccatccggctcatacacaagcctgggggagcaaggcagctggctcagggggtcaggcttgactagggagaaccagtcttttgggcagatgcctttgaggcccattcgtcacagctccttggaaggtctgcagcagggtccacaccgggtagcttgttgaggtgaccagccgcacaatcagggacttccgggcatggctccatgtcttgataacatgccagtggctagaacactcctgagcaaaagtatcctgtcagcagatcacgtgttccctgagaaataaactgctgctgagaagctactattaataacagatggcggacagtttgctgtgatacctggactgagtacctcggtgcctctgctgtctctgggccatctggatttctaggtgtgactgtggcagacgtgtctcgggtgcagaggaaatggaaacaagatggtcctgcttctgaactcggcctcatgccctcatgccccaagtctgaagttcttttggtctcctcttctgtacttctggaagcttccactagtctcttaccatgctcacatgaactaaaagccagatgcctaaatgactaacatgataaaagattggcctgtaaggccacagtgacaaatgtcacctgaaagacgaaggggaaataatttgcattgaagggtgcgcttgcttatcctcaccccttggctcatccaagtagcagaagagtttgggttgcatgaagcttccaaccattcaatgcaggctgagctccacagcagtgcctaggggagcacagctcagattgtgctgagagccacctctcttgtctcacaggtcccatccctgggctgaggctctttatcgaggaaagaaagaaatgtcctgtctggcctcacacacctgaaagtcgagaagcagaagaatggccgggtgcagtggctcacacttgtaattccagcactttgggaggccgaggcaggtggattgcctgaggtcaggaggtccagaccagcctggcatggccaacatggtgaaaccccctctctactaaaaaatacaaaaattagccaggtgtggggccgggcgcggtggctcacgcctgtaatcccagcactttgggaggccaaggtgggtggatcaggaggtcaggagatccagaccatactgactaacacagtgaaactctgtctctactaaaaaatacaaaaaaattagccaggtgtggtgacacatgcctgtagtcccagctacccaggaggctaaggcaggagaattgcttgaacccgggaggcggaggttgtagtgagctgagatcccgccactgcactccagcctgggcaacagagcgagactttgtctcaaacaaaaaaaaaaaaaaaaaaaaagaagcagaagaacatgtctcatgcacacttgtgcttcctgccccctcccacacccaagggaggaggatggtgctcatgcagaagacatgtaatctcttcttccagagttttttgttttataccagcctatctcttacttcccttgttcggccagcaggataaaaatcaatggacatttctatcgccaacctgctgcagctgcttctcagaaccaccatccctttatgtagaggaagagagaggcaatttaaaatggaaaagggagaactgcgaagaggaaggaccaaaggtgacttctccctttatccttcctgaaggccaaaggttggagacagtaaaaggaaactttgctgggtttgtagaggcaaagagggatattatggacttgaaagaacttttcagatgcggttggttacaagaatgaaaatcaggcagcaatgagccaaggacactcagcaatgccatcagcagtacttaattccacaaatagagttatcaggtgactataaggtactcagagaaaaggttcatattttagatataaaaagatttatctcttgggtctaagaaactacatatttcaaagagaagaataatcagcttataactaagaagacagactcaagaaatatgagcagtgaagaagataaatggggaatactgaaagttttttgaatttgcatatttaagctggtgataagaaaataagaattgtgttatttcatcctttgacgaaagcgtccatgcatgaccactccttccataaggaagccctggtacacacagagcctagattatccactgataaccccacaccatctcaacgaagctaaataaagatggagaagaaggggctttccacctctcaccagctggcctcatccagtgtcttcaggaaaaccagcctcctaggctttgactggacttccccatttgtgagatgagggagaaaactcaatgacctctatatcctcttcccactctgcaatgtggtgactgaatcgcatgatggatgattacatggcctttacccaatcccctccttactgttactgtccatctatttcgtctttcctgcctcattgtggagatgctgcaatgtgccactgtggctgtctggactacatttcccagaatcccattctctccatgtctcccattgtggtgcactataaataagagaggttcttaggtgggatctggaagatgggctgaagcagccacccttcattctgcagcttacacaggctgttgtcatctacagcctgggcgttggcatcaggcaacagctgggcctgcagctgtgctgtgtcccctggcctttcctcaacatctctgacccagggccaggtgtgcttgtttagcaccctggtggggaaccctggcttctgcaagaccccagtaagcccagaggcaacaacagtgacacaagttccagcatcagggttgagattttcttgctctcccccacttcatatcaaccttctcttctccagagcctgccatgtggacttcaagctccagcatccaatgtgagacaacagccttataaacactgcttgatcagccctcacaattgcagaaggtcaaatccctataacaaagctgcttgtatatatgatcagacatatgtgggttggaaccttgaataaacctcttaaatggggattgtaattgtgaagatctcataggatcactgggtggtttaagggagatagtgaatgtaaagttggcatggaatgcacagtaaatactgtgttattattaactaaaaatcccagttaccctgctgagaaaatctctctcattttttcatagctgtagaatcaagcgaagtaggcattttgcctatgtcgtaccagggactaagctaacagaaccctggctccactctaaacctaagagaatctaatcctatttttattagagaccagaacatagtagctaacaagtacttaacctctccctccaaggaaatgatggcgaagccaaaaagaacgataccaaactggaaaccattgatttcagtaagatatttcactgtcactgaaggaaaacatcattttaatggtggagtttgatatccacattaaaagacagttaatcgagagacatcatacaatagagctatttgggtagagtacttggtgaactgaaagcctaatacataaattttcctctttcagctcttactaatgaaaaaagttattcaaagaagtatttgagatggacttaaatatcaaaaccatacttcttacttttttaaactacttaatacatatcgtgttccaaaaagatctaagtatacaaaattagagtttttctcatcagagaattaaatttaagtccatcaagaaacctcaggctttctgatctgtacagcactttttggtctttttatttcagtctcaaatattttgaaatggtattaagttgtgtccaaatgacacagtgggccagtggctgggggagggaggtgagacctgaatgccaagagcttggggaaccattgtttcccactctattctgatgtccaagctgacacccacagcccactgactgtctcacctccagtgtgccgtgtgagccacctggcacacacacacttcaaagccagatctcagtgtgatacctaaagagcaaacgtcatcttggtcctcagagccatgagcccttgcagattctctgccagtgtcatctttctttctcactgtcactcaattttaaaacactgccgccaagtgttgttcatctttccctgatggcactcagcaccatcaccgacgtccacaggtgcttccagacacatctccactgtgcctccagcctcctcaccaggttctcaccatcccacacctggacagcctgtgacacagccggtccggggtcaccaactcctgccccctttccatacattcattcacatatgatctagtcccctcccacatacacttcactatactatctttcactatataaacctttaatgtggccaggtgcggtggctcacagcactttggaaggccaaggtgggtggatcacttgaggtcaggagtttgagaccagcctggccaacatggtgaaaccctgtctctattaaaaatacaaaaatagtcaggcatggtggcgagcacctgtaatcccagctactcaggaggctgaggcaggaaaacagcttgaaccccaaaggtggatgttgcagtgagccaagatcacataattgcattccaacctgggcaatagagcgagactcagtctcgggggaaaaaaaagaaagaaaaaaacagtatagattaaaatgattgattgtagagaattctgctggtagaaaagtaaatttatacttgcatgagtaacttctacattctttgtaatggattttacataataggagcaggtattttgtgacagtaataggcccactcaagcagctggatatacagctaactctttatcactgttagggctgaaatgaaacttggtttacttcttacatggaaaaaaagtccttttcccaaatatcaaatatataaacttagattcatttagaaaagttgactcctcagtagataataaatgtctcagatgaaacaaatctctctctctctccttaaacacatacagaataggaaaggcttatacacatgcgtgcaaattctggctcctcgcaatgatcctgagtgtgttattttccatttaagccttggtttttctccttctaaaaatggaagcaatgatatctatgtgacaaagctgtagagaagattaaattagacataataagtgcctagcagaaaagagacactttagacgcaattgataaattgtagccataattatgtatatgaaatacttgtaactataagcccattttccatgttgtttattccttcaaggctacacttgtatttgaatgtctatctgccactgtcctggtttacagcaaaatcaccttataatgaagaaagaggctgccatgtttcgaaacctcctttaggtggaatccaatgggaaataacttataaatacatatttttattgtatatgtaacagtatatttttagatttatcttagtgatgttgtaatggctaattgtataaattctgaatcagcctcacttttccttttaactcagttcatatatcaactcttcagccaatggaaatctcctttatagggtgtggcataaccattaacctccctttgtgccccatgtaatttgactataataaatttcactatactgtcactgctttgtgcatagtagatgctcagtgaatattcagtgaatttaaacttggcaagtagtcaaagagaaagaaattattttaagtaactaaacttaacaaaacacctaactacgcttccggaaataggtaaaagaactaaagattacataaagtatcaggtgttagaagtctagaaaaacataattctccaaattgtgattgtcaaaatgtgagcccagagataaattcccatgcctttgcatatgagcaaattggctctacaatttttacaaaagaactatggctctgcactgttggactcaaacgccctttgtgctgcattttcattaattcaaaacacttagaatcattttgcagagcagctcattttgtgcagcagagggaggccatgaattatctgttgtgcctgaataaagctctgcaatgttgagccgtgtctttgctgagtctaggcgcctccacttcttacatgccatgcgaatgacacagtttgaaaaacacaaccaaatgtacacagtattccatcttctacgaaaagcataaggggggaggaggaaaagaggttggttaatggaagtgagtatagatagaaggaatatgttctagttttcaatagcacagcagaattcctatagttaacaatcatttattgtatatttcaaaatagctagaagatttgaaatgttcccaacacaaagaaattataaatgtttgaagtggtggatattctaaatgccctgatttggtcattacatgttgtatgcatgtaacaaaatatcacatgtacccataaataagtacaattgttatatgtctatttaaaaaaggaaaaaaacaccatttaaatagaaaacaacataaaaagaatgtatacatcctttacattgatgagatctctaaaccagttgtgttcagttccacctttgaaccctcagaacaagggatttgtgcttattgctacttacttgactctacctggtgttcagtctattgtgtacaagtctcctgtacatcttatccttatacccaactctataaattgtaagctccctgaagaacggagctttgtcctgtccttcctgacacaggcaacactcaacatttgatgtctatctagtctacgtaactatctcttccagcagaatcattttttttctttctttccttttttttttttttttttttttgagatggagtttctttcctttttctttttttttttttttttttttttgagatggagtttcgctcttgttgcccaggctggagtgcaatggtgcgatctcggttgactgcaacctctgcctcctgggttcaagcgattgtcctgcctcagcctcctgagtagctgggattacaggtgtgcaccaccacgcctggctaattttgtatttttagtagagatggggtttctccatgttggtcaggcttctttttagaacagtccataaactgccgcctttaagtgactgaatcctggaaataagtgtcaaaaaacctaatgtgtatccatgaaagtattacagtaaataacatgtaataatgtgtatatgagaaagaaattgtattattctgtaaggtaaaatgaggtttatgagaattggacagtagccgttaactgctgttttattatttatccttcatgtataggcaagatgctactgaaaatgatcattgtctaggtatgactgaaaaaacaagcatgttcattcattcgtttgctcatccatttattaaacaaatattttaatcatttcagcaacatgtttgtgttgctgccaaagagaaattagattctaacatgttcaacttaaaaagacttcagtggctccctgttgtctctgggagtaagtccaggtcttctgcgggatacgtaagttctttcctgatctggcctctccctgtttccctgtcttatctctcatcacgcccctacttccaccctttattgttactgtcttgtttcacaccctccatgcctctgtaaatcttgtctctgcaaggaatagttttcttctctctcctaactcctatatgaccttaaagacttacctgaggcaactctgtgccctggtaaatctttcatattattcaaatctagagcagctgttcctcctctaggtacccacagcatcctgggctttcctttgtcatagcatttgtcacacctcttcaaatctgtttctttatctctcttgtccactagactcttgcaggccgtatgatactcttatctgcatgcccagtgcctagcatggtacccagcaaattgtaggcaaccaatacatatttactgacgactgaataaatgtggagactggggcaactatgacaaagagaacagacaattaactggaattcaggagacccggacactgtcttcaaaggttgaaagacttttggaaaattaatctttttgtgcaactcctggcattagctaaggtggttgtccaaagcattccttagctctgtggctacctgacattttctaaaagtgacaaagttctaatgtgtctctagccgagaggaacagttacagttggcacttaaaaacattatttgtttgcttagggagacattctgtatcttaatttcagactacttatgacaggtctctgatacaatgtatggagtgtcaaatatatcatcttttctaggttttaataaaaagaaaaccttaccaaaaaaaaggttgccttgacaatatatctatagacaatatctgaattaataaactgaccatttattttcttttctagttaaggatgccatctagaacaaggacttggtcatgacaattggaaagccatccaatggttcatggctcatggcactcatattagcaaaggtgggttcctgtcatccctaccctgcccttctcagctcaggtgcacatctcctcccatcacaccaaacagccacaaacagcctttctcttttcttctttttttttttttttttggtgacagagtttcactctgttacccaggctggagtgcagtgcatgatatcggctcactgcaacctccacctcctgggttcaagcgattcttgtgcctcagcctcctgagtagctgggatcacaggcgcccgccaccacgcccagctaattttttgtatttttagtagagacggtgttttacatgttggccaggctggtcttgaactcccgacctcaggtgatccacccgcctcagactcctaaagtgctgggattacaggcgtgagccactgcgcccggcccaaacagccattcttactgcacgtctatatggtggagttaactccatttctcaggaagacggacggaatgagtattctcaacagataacagattttcataggctgtgaaaccttagtaatttgaacaatagaagaatgacctaagtcagtagagtctcttttcttacaatggcttaagtgctttcagacacaaagaactaaataaggcatgctaacaaatagattggctggtgaatccttatctttttcttaatgaatacacaatatgtaattgatatgctatctgtatataacttgaatgtattgaaagaagggccttaaatgtacctcaaaaactatgtttctctaggtatatttaatattatttcttaaatactattaattttattacttacataataaagatgttttaggttgggtgcagtggttcatgcctgtaatcccaacactttgggaggctgaggcagaaggactgcttgaggccgggagtttgagaacagcttgggcaatatagccagaccccatccttacaaaaaatttgaaaaactagccaggcatggtgttgaatgcctgtagtaccaacaactcagggaggttgtggcgagacgattgcttgaatccaggagttcaaactatgatcacacctctgtagtccagcctgggcaacacggcaagactctatctctaataataatagtaataaaaggtgttttaatatccctcctcccccaagctccaaaagataaattctaaactagtggagtttggatcagtgagggttgatggggaaaaatgtaaatatagcagtcttttcacttcaggccaggcctcgtgaaatccatatctttaaacttcattatgtttctaaatcccttttttcctttttttttttttgagacacagtttaactctgtcacccaggctggagtgctgtggtgtaatctcggctcactgcagcctccacctccctggttcaagcaattctagtgcctcagcctcccgaatatctgggattacaggcatgtgccaccacgcctggttaattttttttttttttttttattagtagagacgaggtttcaccacattggccaggctggtttcaaactcctgacctcaagtgatccgccctccttggcctcccaaagtgctgggattacaggtgtgagccaccgcgcccggccatgctcctaaaactctaacctgtgactctggaatatgtttacaaggaagctcaagattgaggacactgcaggccatctcaaaatgatgtcagagggcagaaccaacgcttacattaatagaattgctggggcactagttgccttgccggagtggcacccttgaagataagaaacaaaatgacagctcgcaccaagtattcacccttaggccacacagataaatgtgcagcaaacctcttcaggctccacttgtctggagaaggagacacatgatatattgatgtaatgtgggaaaaagacgaattaagtaattttaaaaattattttaataggtcatctatctagaaagaatggcaaagaggaagaccagggtgggtgggcaaaatgcaccattttgtttgttaagcaacatcttaaaaggtgcagttaaaatatatgtacacttcctcaaattaagcaaacatcatcattaggatatttcagatactgaaactgatgagaggcatcccacgcccctcttttttgagacaaggtctcttctgttgcccaagctggagtccagtggtgcgatcatgtctcactgcaaccttgaccttttgggctcaagcgaccctcctgtctcaacctctgaagtagctgagaccagaggtgtgcaccaccacacacagctactttttacattttttgtaaagatgaggtctcactatcttgcccaggctggtctgaaactcctgggctcaggccatttccccaacgcctcccaaaatgctgggattacagctgtgagccaccttgcctggctgaacagtacctcctgagatgaagcaaggtgtgggcaggcttcactaaagggcagcattacaacagggaaatagtcatgcgatatgtctaaagcaaattatcatgcctaataatatttctttcagttgaataattacaattcattatggctcatttcttatcattaatattttcatttaaaattataaatgagatgatcacataaaatgaaaaactgactttaaagttaaaataacacacgcttttcctcaggaaaagcgtgatcccagcattttatagaattggaaaatatttgggtgatgatcaaatccaatatcctcatttcacaaatacataagatactcaagagtctaaatgatatttcaattttatccaactagtttggaataaatccagcagaaccagtgtctctggatccccaacccagtgtttccagaacaatattctgtgttacataattttatatttatttggcaaactacattttaaagttaaaggatctaaatatagaaatagtttcgtatattatctttcttaatattaaaataaaatagaatatcttgtattgtatttggtggactgtttttgaagcatcaaatttatgtattaataactatggatcatgtattattattcctcaatggcgaatttggcaccctacagaaaatagtcttcatttctttttttttttttttttttttttgttggccggggggtgtttttttagacagagtcttgctctgtcacccaggctggagtgcaatggcatgatctcggctcactgcaacctctgcctcccgggttcaagcaattctcccgcctcagcctcctgagtaggtgggattacaggcgcccaccactatgcctggctaatttttggtattttgagtagagacggggtttcgccatgttgggcaggctggtcatcaacccccgacctcaggagatcttcctgcctcagcctcccagagtgccgggattacaggcatgagccaccgtgcctggcctatgttccttcctttcaaagaaacattcatatttgaatgacttgactacatagaaaccttgaagaaaattccaaaatgtaggaaaattacaggccatgataacataatttaaaacataatctaataaaagtataaccaagcaataggaagatagtttagtatttaaaccatttgaatataaaagccttttaacctttggtcaacagagaaaatccaattatatttaccattatctaaacgtaaattaagtgggaaaatacctacaatgtgaatgttgatacagctgaactcggaggatccgaacagctttcagatattgaaaggagagaagacataacctaaacttacccaatgtgggtaaacaggagggtgatggggcaagtgaagaaggacaaggctggaacatcatgctaattctaagtcagattacaaagtgtttcaatgccgtgcaaaagaaatctgaattatttttagatgacaaaaagagcacatcagaattttttaagaagcagagaaggacttcttggcaacacagctgactgaattgagaagggctcttcttcctgctccaggcagaactactggaaagagagacagagaggacacagagagagagagagagatcacaaaggcagagaggaaggcaggctgacgggaaactccaggggttggaaaggcagagggaaggccaacccggagtggtgagaacaccagctgactccgcatcagcctagggtcctggtcccagaccctgctgtcaaggctgaaggatggagctgagcatacttgctaatacgagacacgtgttttagggcctgcaagaggcagaaagctagatctgagaatctgtgcataagccatgaccctggaagacacacttggaaaaggggtttacaaaacttcacccaaataagtggcaatgaagcccagggctctgggaggataaaaacacacaaaaaatgttataataaaagtagtaactaaaacagtgacatactggcatagggaacagataatagatcaatggactggaatagaagccctacatagatatgacatcttggtgtacgacagatacagcattctgtattagtagggaaggatagagtcctatataaatgagacctaaatgtgaaaagcaaagtgttaacatttaagagagaaatataggagaatgctttgtaacattagtataggaaggctttattttaaaagttcatgaaaaaaagaactgatacatttgtccccactctatttaaagcatctgcacgtttagacaaactataacccaagtgaagacaagccacaaactggaagaagacaccactgataaaagattagtatccaaaatgagtaagaaaactgtagaaatcaatatgaaaattcaaaaaaaggcccaagggaaaaattgaggaaagacagaactaggcagggcacagaggaggtaacctgaagaaccactggccgtaaggaagatgctccacctcagcatgaatcagggaacgctgaggaacatggcaaggctgccccatcttatagccattttattgtggaaaaatctaagattccgaagatactaagggagaggaaaatgcagagcaatgagcacttccataaactgccagtggccacgtaggagtttatttgtatgaccagatagagagaaatgtgtaaagagctactaaggtttagtattcacatttcactggacctagcaacttcgtacctatgttctaggggcactattttcatatgttcaagtaaacacgtacaaggatttttaatgcagccttatttgtaattgcaaaaaatttggcaacatacaaaatgtttatcaacaggacaatgattacatgcattgtggtagtgtcataaaaaggcatggcatgcccctattaaaataagcatactagagcaatttttctcaaaatgttgttcaggaatagcagaatcagcatcacctggaaacgtattaaaatgtaaattcgcagaccccactcaagagctactgaatccgaaatgctggcagtgggacgcagcaatccgtgttttaacaagctcccttcccccatgtcaggttgagagcagttatactggatttacctgtgtccacatggataagcttcaaaaccaaaatctgagccacaaaagcaactatacaatacaattaacataaatcttaagaccataagtaatatatggacagaaaggatatatgccaactttaggagggatgaaggggtaatagaaatagaagggagaggatttcaaatgtacccataatatgtgatttacttgacaaaatgatatgaagcagatctggaaaactgtgagtatttgtcacatcagcgtgataagtatagaggtgtctgctagattattctctgcatttttcagttagttttgaatatttcacaagcatactggcacagccaagtcagtgtttctgtaggataaccacattgtaagggaaggtgtaaggcaggagagatgggaggcaggggcaacaagttcctatattgcttcagttacccagcaaaggaagggagctttaactgaggtctcagttttctaggacttgatcctccatttggtgctgggagtgaagaaaaggggcagccaaagaagattccaaaatgtgcagctatatggaatgaaatctgaatctgagaagaaaatgtatgtcctcattcaatagttggtatttgataatagagacagcaaatggtggtaaggcaagatgaaaatatcactgacaacagaacccttgggaaaataaagaggaagcaaaaaaaaaaaaaaaaaaaaaaggaatgcctttagaggtaggaagaaaaaaggaagcaaaagaatttctactgaagtcaagagagttttacaatggaaaggatcatgtggtagagaaatgtctagcaagctaaagactgagaagagacatgtgatactaggaagagaatttgattattacagtcctccctccagccccctgaaatgcttattttataagagatcttggagaaagtctatttcattatttgaaagattaaatgtgcgatatggaattggcaacagcaaatatggacttaccttctaagatgttctgagacaaaacataaacacaggggcagtaactggtgattaaagtttaggaagaggtgggataaaaatggaatcatgatcccgggtgaaagggtcagctttgggaaagatgaggaattcttgcttcgggagaagaggtaaggaggagatatcaatacagtgggaagagatgacgagatgagtttaggaaagttcaaggagcaaatagctccatccagcaccagcttggaggcaagagcacatcacaggtgccttcatgcccttaagcgcatcacagtggacttaaggggccgaggagaagagacaaggttggcactggagaatggaaaatggggtttgctaagaaaaggtcaaagaatcaccatcccatattttgaggaaattagggacaaaaatattttatataatgagtgagcatagttatttcaagtagcctgatggcagaacaggagagggtaaaaaagacctgggttcttctgaaagtgaagaatgagaaggcaagcactccaatatttgcattatctcaacatacaatgatctggaagatatgctagagccacctccaaaatatactgaatttccatccattcctctttcccctctagttcttcatgctatgatttctcacccagaacaagacagtagcagtaactattctcatttccactatgctggctccctaagactcattctccctagaagccagagtaacttctttgaaacgcaaatcgtatgatttcactcctatgcttaaaaccatccaatggcttctcactgtcctagaatgaaatccaaagatggaccctgggaagcagaaaagatgacaatcaagagttcttcctgtctctcaaaaaaagaaaagaaaaaaaattatatatatatacgcatattccttaaggttaaaaatacccagttcgctccttttgccagcaccatattgacagcctcaaattctattcaatgattttgaagaataaatgtttttataaaacttaagtaacaaaaagatctactacacaaattaaatcactgttaagtgtgaactaggtaaattaactgataggaacacatttacaaggtatgtataggatttatgaaagcctatactctacttttcctctaaaagactgatttttaattatattatttgagtgatcatttgatctatgtctgtctcccctgttggagtgtgagcttcaacaagacgaagatcacctctatctactttattcacaggattatccttggcattctgcacagatccgacatgctgtaggggctcagtcaatactggatggattaccgaataaatgttagttaaattactgaatactcaacgaagtagaacagaaaaggcttgggcagagtcccaggcaggatgaaggactgcagtccaaactctatgattaagaaagtatgagacttgctatattagtcaattttcatgctgctgataaagatatacccaagactgggcaatttacaaaagaaagtggtttaattggacttaacagttccacatggctgggaaagcctcagaatcatggcaggaggcaaaaggcacttcttacatggcagcggcaagagaaaatgaggaagatgcaaaagcggaaatccctgataaacccattagacctcctgagacttactcactactgtgagaacagtatgggggaaactgcccccatgattcaaattatctcccaccaggtccctcccacaacacatgggaattacaggagtacaaatcaagatgagatttgggtgggcacacagagccaaacaatatcacttgcttatgtcacattatctttctaagccttatttatcttgtttagcaaatgacataacatgatctgcaaaagcaaatgaaaacgctgtagtgtcccattatcataagctgtgatgactaacaattacatggaacttagagtcaatttgttttctgacacactaaaagtcctcagggttgaagaaagcaacagcatctgccatttcattttctgagaggcatcccacataaagcaaacaatgtcagtcacctgccatctctctaaagacccagtgtttgtaagccatgaggccccagggttaggggctctctttaaggcctctcagactctttaaggactttcaagcctaagcatttttacccagcagcatctcagaagcctctatctaatactagaaataagacagaagctatataagcccgggaggttgaggctgcagtgagccgtgattgcaccacttcactccagcctgggtgacacagcaagaccctgtctcaaaaaacaaaaaacaaaaaacaaacaaaaaacaaacaaaataaaggaagataaagtttctttacaaaaagaggcagagaagacttcatagagatatttgctattcaagtgagaatgctcagatcttctcatgagcacaaatccattatcaaaataactaagaatctaagaatgaggaaacaccactgacctcagtgacaagtcattaaacttcaaataaatactcatgatgctttgcagatatcattgttgtggccaataacaaataaaatttaacccagcagctttaatgtcacagcccttctattttttaagtgggtatttctacaaacatatccattaaaccccgagtttgcctcaaaattttaaaacacaattttaaaacatttactaccatcactgagttgttcctttccaacctggtatccattagggacccttttgtttggtttggcacagacagcccattctatacatactgattaagattttactataagaacatttcttacaggcaatccagtatatatgaccaaatttgtatattttatgttgccatattccctgaatatttaaatgaaaagcctcaacaaaaagaggatttgaaaaaatgtcaatatgctaaatttagctgatcttaaaaacaagcctatcttagaacattctctcaggtaaatcatgcataattcatagatttttcccaaaacattatatacacatccatgcatctcaaatcattaaaaaataaattagtttgaaagtgacaatagtcaaataccatcctgggatagaaaagttacagagatagcaaatgtcttacattacaaaggatgtacctttgctatccccagagcagtattttacgcagacactgctgtataaaaaagtcattagttgttttattacatcgttctgtttatttatttttaataaaaatggtgtaaatcattaaattattctgaatttgaaaggcaattcccactcctgctggaagctagctgaggactggatggccctgctgttcctgcttgcgtgaactatccctcctggtgaattatacaactagttaatatacaaaagaaaataggcaactcccatttggcatgtcattcttttatgcccgagagctcacttcacatgcaacaaatctccacagcagtactgaaagggcctaatgaaggaacacagtgatttaggtcagcccagaaaggctttgctttcttcagtgaagagtgtcttgacagaaagcattttctccgatgtaacattacagcttggaatctgccaaaacaacagtcggcacccaacaccgacacctctacgttcactaaatagacgtttttatttacttaatccaaaaccagagtggtccaaagcagttagataaagttgagtattttcctcttttgcaattgtaattgaaattctgttggttgaataaaaactggaacttgcctttctgaggaatgaattcatgccacagaacttgttcagaatttggaatgcattttccatatgatgatggcaggtgctttctcacgtgtgagagggcgacactcctaggtaagtctggccacgatcaaatctctgtattttcttggcatgcagcccttgtttagtggcctccttggccagctgcaccgaggaagcagggactgctctctggggagcagggtgaagacatccagctctgagccctccagggcctatttataatagaaaaacagcctctgttcccttttcaatgcaaagtactttctcatatcaccttaaaacttatttatactgcaggtcatgcacaatggctcacacctgtaatcccagcactttgggaggccgggcgagcagatcacttgaggtcaagagttcaagaccagcctgtccaacgtagtgaaaccctgtatctactaaaaatgcaaaaaattagccaggtgtggtggtatgcgcctgtaattccagctactcgggaggctgaggcaggagaatcgcttgatcccagaaagcagaggttgcggtgagccgagattgtgccactgcactccaccctgggcaatagagcgagactcagtctcaaaaacaaacaaacaaataaaaaaacaaaacatatatacatatatatatatacccactgaacaataaaattttcctacatttgggaagaaaagtaggtttcataaaggaaattttaatgaaacaaccatttataaagaccaatagcatactgttttccactaatattttttcatgattgagatcttaaagtttttctatagaaaataacccagtaattttacattttaattatgtccccttttatatgttttctttgtgtctgcctaatttaatattacttttttttttcttatcaggcctggaagctaccactctttggtattacttactaattgtgtttgtagcacttactgagatacattagctcaaattgaaatggcaacatgaaatgcaattatgcctacttatagacattctagatgtacatgtaccatattgccttaaagtgcagtttgttttacctgctagaaaaactgtgaaacaggaacacagacatgtacacagaactgtacagaatacaaaaaaaaatgtctacagtgttttcctttctcacagttttcatgtgatttagacattaaatgtcttatatgtaaattctgcaactgtagaaaatgtagataattaaaagggaataggaaatcagaatctaagccatcatttaggttctctatattgttcatggactattaataatacatgtatacgactaaagagatcatactaataaagcccatggtctggggagagtaagggactagtactcaccccagaccactctaaagaccaccatctcattcttgtattaagactccaaattggcatccctgcacctgagtctaaccagccccccatgatacgtgatctacagctttgtatagaaaaaaggacacaattctagtgagcactgtttcttgaaaactgcacttcacataaagagattttaatttttaataatttaaaagtaatggagattacactgaaaatgatgatgtctcaatgaaaataagcctcagctaatacaactcacatggagttgtatacaatggagagttatttgaagcacaacaccttatatttatgctgtgttagtgaaatagcacagaaaggttgatgaaaagtgttcactgcatgccaataagccaaacatcacaggaagtgtgtaaatggattaggattcttagacgaatctatctagcacagcaatatgtaacaaattaaagtggaagaatgaaaatgttactatcatcactttccttacagcttctccttactaaaaatgggttgtgtcatttcttattacaacaaaagattttcttgatggggatctgctaatatggtcatgggaggggtggaaatcaagcattaactatggaatttagcacaaagtatacctttactcacaaaaggggggaaaacattttagcatgaagattgcttggtgcttatgttgcactgctaactgcatattctagaaataattaatgctagtctcaattaccagcatgcaactcacattttcagctaaatcaataactgaaataacaacaagggagaattccccttatattatgaataggttctcagccttatttaagcatcagaatacctgggagtcacaatgttctttgcagttattgttatacctagtgtccgtcataggtgttactaattttgtcatgcataagtggcaacaatgttattacaaaaatcaaaattatgagcatgcacatccacaaaagcagtaagcaactgatctaagtatgactggctgcctctatgctgtactgtgatattcgtgtgtgctatctgcttgcttgctaattcctagctacactttattaacaaaggtaggtttaaaaacaattataggataaaaactttaaatttggaatatattatccatttacttatttttcctgaaaaatgagaaaacattgcaattattcaattatagtgataaaagatcagtctagcatacggtgctatgcacaacagtactaactgttggtcagacgtaatctttgccttcgaggtatttccagtctgttagggctggcacaaatcctaaacttttaaatatgtttctcatatagagcacagtagcactgacatgggctacttggctcactaaccattgaagatgaagaatgcttctcagggaaaattatacctgaagcagttattaaaacgagagcctgaaaggaaaggtggaaattatatccttggcagaggaagcagcatgaccaaggcaaggagacaaaaaaaggcattccagctgggcgtggtagctcatgcctataagcccagcactttgggaggtcgaggcaggcagatcacttgaggtgaggagttctagaccagcctggccaacatggtaaaacttcacctctactaaaaatacaaaaactagccaggcatggtggtgggtgcatgtaatcccaggtactccggaggctgaggtgggagagtcacttgaacccaggagggagaggttgcagtgagctaacaccactgcactccagcctgggcaacagagtgagattctgaagaaaagaaaagaaaagaaaagagggaaagaaagagagaaagaaggaaagagagagagaaagagaaggaagagagagacagagaaagaaggaaggaaaaaggcataccatgggcgggaagccaagtgatagcttttcatgactggactgtcaaagttcaagacgagtgactggagaaggtaactggacataaaccagacttagaggatggaatagcaattatgaattgggagacaaggcaaatgttgacaattttaggcatcaggtagtaaaactgtcctcattcttttgaaaattaacctcgctgggcacagtggctcatgcctgtaatcccagcactttgggaggctgaggcaggtggaccacttgaagtcaggagctcgagaccagcctggctaacatggtgaaaccccatctctactaaaaatacaaaaaatatggtgatgcgtgcctgtagtcccagctacgtgggaggctgaggcaggagaatcccttgaacctgtgaggtggaggttgcagtaagccaagattgcaccactgcactctagcttgggcgacacagcgagactccatctcaaaaaaaaagaaaaagaaaaagaaaattaacctaaaaactaaaataccaggaagaacaattgtgtttataataattccccaaactaattataaattttgcagtagacaaaaaaatataaaatatgaaaatagtaagtaaaatagggaaacatttcttaagactaatttcttctctttcaaaccctcttggttggttagtttttaccttccatcttgttgaaattgactttttttttttctgaaaaagtaaactgaatcaaattcaggctaagcttaatgctaccaatttattttcaaagacagataataaggtcacgtagggcagttgtggggaaaggttagaaaaagtgagtcgccctgtatgataaatgacaggctcaatgcatccgttccttccagaaaccctcaacacaactggctagcttttaatgtaatcagaagatatccacatggtctttctctctgtcctcttctcctcacttggtgattttaagaagcaaaagtctggccgtgatggctcaagtttccttgaacacagcacaaaaagataaatgccagtattgcacaggaggagaatatacagaacaagagttctcagttctggccaggcatggtggttcatgcctataatcccagcactttgggaggccaagatgggaggatcacttaagcccaggagtatgagaccagcctgggcagcagagtgagacccatctctataaaagaaaaaacaaaaacttttcagtcctgatgactaaaaccatcaaaaatgagactatattttagactaaaattagactaaaactataatttttctttaattaaatctattcatgtagtataagtggttaatagaaagtatttctgatttgtaatattatattgcagacattagattgatgtttaaaattgcaaaattgcaagagtgatatacaaaaaaaaggaattattctagacaactagagactctcctatatttaaaatttaaaagcatggtattgaatatcctatttaggaggcctttgacaactatttttactttttttttttttttgagatggagtttcactcttgtcacccagactggagtgcaatggtgtaatctcggatcactgcaacctccacctcccaggttaaagtgattctcctgtctcagcctcctgagtacctgggattacaagcatgcactaccacgcccagctaatttttgtatttttagtagaaacgggatttcaccatgttggccaggctggtcttgaactcctgacctcaggtgatccgcctgcctcagccttccagagtggtgggattataggcatgagccaccgcacctggtgacaacttattgttacttctaatggtttgggagaattcaaattatattagtaagtattttagaaataaaaagccatatagtcatgttaatatgctcataaaatcagaagaaatataaagttgataatcaagaaagggtatataagtattggtagatgtaagtgttggtaatataagtattggcaaagtattggtaagtattggtaaaactaatttctaacttcaatgttaagaaaagcaacagtctttgaaatgagttggttatcgggtacattgtagattctggttttacttattcaaatttttttttttacttgaatcagctttctcttcctatcccccatctctaattatgtctaaatgttcttttctgttcatggagttattaaacaaataaacaaactctctgggagcccttgaccctaggggataaagaagactgagttcttctttcttcctgaaaagtactagaaagttcctaaaggagctatgtctgtactactaataggctagggccgcatgtgactgtcaaaaagggtctctataagaggagtcccaggaacgccctgaagtatcaattaaaatgcagctgtttggtaccacttgttcctgcggaaacttagcagtggagggtgtttcttaccccagtaagctgcttctttgcgctaatgcagcgattgctgtgcctgagggcagccctccctcccagtcgccagttccgtctttgcactgcatgttctctctgatccttctctgatccttccctccttcacagctgatgactgaattcatctttgacgtgtggtccctcaactcaatgtaatcttgcatgaaagttcaatatctgccatctggccaggtgtccacttatcccactacccttgaactcccagctccttctccctaactcctctgctgagtgccttgctgtggccccagatgttgcaccatacacatctgcacacctatccaatgaagcagattaagtcccacccacttccactggacagaacagtagtctcttacatcagacttagctagattcctgtatcactactcggttatattatattatttgaaaacatttctggccaggtgtggtggctcacgccagtaatcccagcactttgggaggccgaggtgggcggatcacttgaggtcaggagttcaagaccaggctggccaacatggtgaaacactgtctctactaaaaatacaaaaattagctgagcatggtggtgcagcctataatcccagctactcaggaggctactcaggaggttgtggcatgagaatcacttgagttcgggaggtggagcttgcagtgagccgagatggcgccactgcactccagccggggcaacagagcgagactctaccatgaaaaaaaaaaaaaagaaagaaaagaaaagaaaaaagaaacatttcttattgaaacattcctcacttgcattcagtgaatgacatttatttgatgcctactatatagctggaattctgctgagcatagtagttaaagaaattgctcagatatacacttgcccttgaggagtaagcaaggcagtgactatctaaaaagtgaggcagaagtgtaaataaatggataaaagagaatgtcctatggtggaaatgcagtgaaaacaggaggtaattcctccttaatggcaaggttaaggatggaggggatgccaaggaggctctcaagaatacagatatcttcctggcttacatcaacagtttatacaaattgctgcattttagactcttgtggggagctttaaaactcttgatgtccaagctgcatcccaaagcagttaaatcagaatctctcggggtggggtgggggagggctggggtagaacccaggcattttttttttttttttgagacggagtcccgctctgtcgcccaggctggagtgcagtgacacaatctcggctcactgcaaggtctgtctcccgggttcaagccattctcttgcctcagccgccggagtagctgggactacaggcacccgccaccaggcccgactaatttgtttttttttttgtatttttagtagagacggggtttcaccacgttagccaggatggtctcgatctcctgaccttgtgatctgcccacttcggcctcccaaagtgctgggattacaggcgtgagcgactgcgcccggccaatatatttttttaattccctaaattaaaaattattccatcgagcagcaaagcctgagaaccagtgaactagatcattgcgtccttgataaaataatcttacactaatcttagttcaagagcctggcaagcaccatgcctactacatgttcttatgtgattttggcattgaatttaaaaaactgaatgaaggaatcattctggtaaactaaaatggacaaaaaaactgggttttatgttatctcaaaaattgtctacatcatatattatattaaccaacaatcttttagactttaatagtagaagctgtagttatgaatagatttatgtataccatgaaaaaaatgtacggtagttattctttcctcaattgtcattttaaacagagccatttatttattaatacacttagctggatgctataagtgaatacaattagtaaaagtgataaaactaagtttatgcacaactgtgaaaaatgtgtggtagttgttttaaaaacttgttttcataggtcaagagcttacaatgcattctccatgaaacagactattcattagtttgagaagataaaacaacacatttatggaacactcacatggtgagctaatcagttaacagtcttactacataaaaattacaagaattttcattaacaaaataatagaaaattaaaatgtaacattaatataagcacttatcattacattaagtagttctatatacacacacagacatccacacttatgtacacacaaatgcatacatttacctcactgctatttataattatttaacagtaggttagcatatttattgatatattttttgagacagaatctcaactgctgcccaggttggagtgctgtggcgcaatctcggctcactgcaacctctgcctcccaggttcaagtgattctcgtgcctcagcctcctgagttagctggtattacgggcgggtgccaccacgtatggctaatttttgtttttgtagtagagacagggttttaccatgttggccaggctggtctcgaactcctgacctcaagtgatccgcccaccttgggataccaaactgctgagactgcaggagggagccacaatacccggccagcaaatttaaataatgagaagcaaatagtcctctaatagtaactattgcatttagcatgtttcattctaactctaaactcacaagacatagacatgtaagtttagtaccctagaaaacacagctacataatttgaattattcacaacacttcatcacaacaaagaaattactaaatttgccatgtatgtgtatactacacatggagtagtttcacaaagcaccattgttacttacgttatttcatgttttaaattctgccttcatagcatggactttcagctatgcctcatttaaaacttactggctcgggggctcatgcctttaatcctagcactttaggaaaatataaaaattaaccaggtgtggtgacgcatgcctgtagtcccagctacttgggaggctgaggcaggagaatcgcttgaacccgggaggcggaagttgcagtgaaccgagatcgcaccattgcactccagcctgggcaacaagagcgaaactccgtctcaaaaaacaaacaaacaaaaacctactggcaataagggagggtcagtatttacgaagtgactcatttaaaatacggaataacttaaactagtacaagagtaggcatgctgtcggagtacagatgccagcgaattaaggctctgtgctgccttccatgttccaaaggtagcttgagcgctagtgtgtcaaatcaattgagcattcagggctctgggccagttactagtattagcctatgagggctcttggatagctttattttgggctttgtgtggtcaggaggtgccccagccacaaacactttgagaaacaggccctattcttaggtgatgcttagatgaagtgataatgtattattaatagttttgatattaacatatgtgagattttgtatgtgtgtgtatgcataaacatagttcagactgatataatactgacttctttctgaggccatggaattataaataaagaggcccacatgaaacaaacccatctcatttattctatttcccactgaataaatggcacttagtccaaatgcatttatttttaatatatctgatgcttaacccatgaccaaatggactcaggaaataaactgtcttccttgggtaagaagaagagatcctatgttttaaaggattttacattgtttttgctgtaatttcatatatgaaggaaatctaaaaactattcatgatttagattcattcatgattcacaaattgcattctgtgaatcaataaaataattgaagatatcaaaatatattcactcatgttaaaaaatacggctgatggttgagcacagtggctcatgcctgtaatcccaatgctttggaaggccaaggcaggaggactgcttgagaccaggagtttgagaccagcctggacaacatagtgagaccctcatctctacaaaaatatatatatatttttaaatatggcttagtgtggaagaacacatttttggatttgcaaatcagttaatgaaagccactgatcatttaccttccaaagaagaatcagacatttctaagacatctacactatggtacacttcactggctactattttagtttaaaaaattaacataaatttcattttattagctgatgtttttagtataagaaccagttgcactaaaaatcagtagcacttataatgaactctaagcattgtaaatggtgacttgacataatttagcattgagatgaattcagggaaacatttttcttttgctgtttgtttgtagcatctcagatctcccctcccaactcctctctgtccaccagttccctcttgcccaagtgctgctattctcttggtcactcataatcatttagcctgtgaaatttattctctatttacaactggctgctacatcactacttctgaacctcttgccaaatattattacaaaccaatgaatttacaaaatctgttcaaacacaaagatgggcaagagagactgtattgtcttacaattgcctctgtgttccttaagatttagtgtattttcttccctgggcacaaatttggtatttacttcactatttcaagtaattacttacttggttttgtcattcaaatttttaaatggaaagaaaatgtctaaggcccttagtttaaaaaaaaaaagattaagagtgtcagaattattctgatccaatgactttcgctaagcaaatctttttaaaacagctcaaatagtatgagcattttacaaatgagctttaaacatccttaatctaaattgttcttaacttctgaatacctagaaaactactatttgcagcttaaatataaacattcatgccagactaatgcagaaaaatctagggcaaatccatgattaatatttttttccagtttgcaatatccagctctatttaagaaagggccttaatgaatgctgctgtaataatttaaatagaaaattgatttcatttttgcattctcactgtcatttcaatcagaattgtcactatcactcacatcttctattcatcattttgatttctatctacactcatttcacaaatgaaaaatacatcattaaactcatcacattttccaaaactataagcaagcacatgaaatcctctcttctttgtaaagaactgccaacatgagagggcagactctagctagtaaagcaaaggatggatggttcaaatttatccttgtaagttatggctgcatttaaatttaattgtctataaactaaagggtgcttttctccctctggataaccttaaatatttcaccatggcttattcaaactactgtgaaaacttaaacatatattcctcatgattacatccattttggtctttagaagaaaaactagcagagcttaaatgtattataaccccttcttggacacacgatgttaaaaaactcagtttgttggaaaaaacatattactattctatacacacacaaactccatatagtaattccatatatttacattataagcatattatatatgtgtgtatgtgtataacgtacatatatataatgtatgtattatatgtatttatagtgtatatttatagttttgtcaaccaaatacttactgtttaaggaatatggtttaagcacaaaatattatatggttcaaattgttaaaaaatcacagcttacttaataaaagattaagaaaacctaagcaaattgatcataaatattaggggcaagtaagcatgaatagaattttaatttaacatctttattttgactcagtattattgttttcaaatcataggaggtttgacgcaatggaatatcaaactaagaaacacttagtgagattacttataaagatgtaactcactttttattcgatgtccccagttaatgcttattatcctcaacctgatagttttctttgagtaagaattatttagtgctagaatattaatacttgtatgatcaattacaattttattttattttgtttttttgagacaagctctggctctatcacccaggctagagtgtagtggggcaatctctgctgactgcaacctctgcctcccaggctcaagccatcctccaaactcagcctcccaagtagctgggactacaggctcagacaaccatgcccggctaatttttgtattttttgtagagatggggttttgccatggtgcccaggctggtctcgaacttgtgagcttcagtgattcgcccgcctcggcctcccaaagtgctgggattagtggcgtgagccactgcacccagccttacaatttgattttgatgacactagtcaacagtaaacacaacaatggctattggtctataccatcatgataaagcagattaaagaatatttggcttttgtttgctttgttaaactgtttctaataaagtgagcaagttttgttttaagtcacccattccaatgaatttgctacgtaggctgctggtcagcacaaaccatgatggggcaggtgaacaccttactccaagagctattaggtgagacacacctaacaacatcactgggtttttctcccatgctctaaagtctttctaacactaaccagaagtactacatctgttacacaataaatagtcctctgtcctataacactgtgagtcagatgaactgatcagaaaaaaaaaaaaaatcaatgtttacagagttataacttcagactaaacaacaacaaaaagaaggcatttcagttggaccatagagccttgaaaaatgtaaatgatttaccttcaaccctgaccattccagcaaataaccccaatcaactcttgctcctcaaattttccttcctcttctattttctgttgattctattaccagcatcgaaaccttggagtcatggctcatgccttcctgatacagtcacatccaagaagctctaaagcccaatggctcaactgtgttccctcctctccatttctgctgttacctaagttgagtgcttataaagtgatcagaggagcaatttagaattcatcaaattaggaatgactcttgatgacgaaattacagatgaggcagtgggaattcacaggagagtgggaattcacaggacagtgggagtcaagggagaccaaggacaaggagatgagttcatggcttgttgtttagatattagatgtgacgagctgaaagtctcaatggaagcgatggaaagtagaaatagtataaaagaaaccaagaaagaaaaactccattgggctaggtacagtggctcatgcctataatcccagctctttgggaggccgaagtgggtggatcacctgaggtcaggagtttctgagaccagcctggccaacatggtgaaactccgtctctactaaaaatacaaaaattagctgggtgtggtggcgcacacctgtaatcccagctacttgggaggctgaggcatgagaatcacttaaacccagaggcagaggttgcagtgagctgagatcgcaccactgtattccagcctgggtgacagagtaagactgtctcaaaaagaaaaaagaaaaaatccattggttattacaacagatttgtttatggggtcaaaaaatctatgaagtttggctgggcatagtggctcatgcgtataatcccagcacttcgggaggctgaggtgggaggattgcttcaggctaggagttcaagaccagcctgggcaacatagcaccaccccatctctaaaaagaaattatgtttaaaaaacaaaaaattatgaggatcaaaactataaggataaagaaaaggaagagtaaggatagtgtgagtgtgaataagcacaacggctagatttcaaagcaaatccagaatacgggctttgctggtgaccttggagaagttacttaacctttctgtgcccccgttataactcagatgtttaaaaaaaaagaaatggggttaacaaccctatatcctatggttcttttgaggattaaatgaaaaacaaatatgcttatgaagtactaaaatcacattattagtgaatttaaaaatcttttagccctaaaatttgattttctgtgtaggagctattgtaaccctggatatttttaatcaacatattttatgctacaatatacctaaggcgtcctgcttcaggatgaccacatccaataaatattcaacaagcatctgggattgcacttttaataaacgtctctgtgttgaaagagaattcttatcatttggaggagtcattttatttatttattggccttggaattacttcagactgttgataattctgattttggtaatagtcttgggtgagaaaattgttcaaggactaagagtgacctgtcatggtaacaacagtctgtgaattctataaaatataatgcatggaccttggtttggagaagagcaatttactttagggtgtattcatccataattctcttctcttgagcaactttcatttttatgtgaattctttacaaagtcaaaaacaactgatgcattgtcttagctacatacaattcatttaccagcacctaaactatggaactgcagtgacttaaagggctagcttaggaagactaactagtttgaggtaagtttgcaaactaaaacaacccactttttgatactacatcaaaaactgctttccaaatttttagtagaacttctcttttaagcagacagtataatcattttatgaaggtttttgtgtcctctaaaaagaattcttgtgttccaaactctcccaaggttataagactgaagtcaaaactatgtgatgtatactggccccatgtacacttttccatgtgaaatatcactgattcttcaaaatggaggttaaaatgtaagtgactgatctttcctcagagaattccagaaacaaatatgctttcctactctccaaagacaggaagatgagcaaagtgagaaataaaatgtcaactacttcgatcaaggatgacacctgagtgggaggccccagcccacacctgggctccaagcgccagttagtcctgcttagtcctagctctgcccctttctagctctgtgaccctgaggaactccctccaccaagaccactctgaccctctgtgtgtgtgtatttgttctctctgtaaaagaggaacaataacctcttgccaggtgctctctgacttcatctccagctgctgtcccctgggttcagctcactccagactcacgggccttcctgctgcccggtcctcccacccaacctcccctgagcctgaagggcctctgtacttctttcctccccctgaaatgctgggcccaggctggccacatcgctcactccctcagagaggccaggcttgatccaaatcccacctgccccgtgaggcgtggcctcatctaaagtcagaaattggctccatctcctcgactccctcccacaattccaatttcccattctgccttacatttctccttagcacttatggccaatacactatttaacgactgtgtgttctcttccttccttaattaaatgcagccccacgagtcagagattttggccaattttgttcacttcatatttttaggatccagtatagtgtctggcatgtagtaatgcttaaaaaaatctgtggaataaataaatgaatgactcttctccacaaggttgtcaaatgaatgagatgtcatcggttaaatcgctaagctgtaaaacatatgattcactatttatttttaaattgttaatttattattattctttggagacagggtctcactccattgcccaggctggagtgcaatggtgcaatcacggcccactgcagccccgacctcccaggctcaggtgattctcccacctctcagcttcagactacaggtgcaaaaccacacccagctaatttttatatttcttgtaaagctggggtttcactatgttgcctaggttggtcaaaatttctgaggctcaagcgatccgcctgccttggcctcccaaagtgcagggattacaggcatgagccactgcacccagccttttaatttattttaacattctgttcatgaaataaaatgtagatgacaaactatcggagtcaaggtaaaaataattaaatagaaattagttataagaactataatgcagaacctccacaaggctaagggaaaaaaaaaaacaactactacaaaatacttggtatcattagaagtaaaaaaaaaaaaaaatcagaaaacagtcaaaagcttaaaaatgaaccaaaggtggccgggcacggtgggtcacgcctgtaatcccagcactttgggaggccgaggcgggcagatcatgaggtcagaagttcaactccagcctggccaacatagtaaaaacccatctctactaaaaatacaaaaactagccgggcctggtggcgcatgcctgcagtcccagctactcaggaggctgaggcaggagaatcatttgaacccgggaggcggaggttgcagtgagccgagatcgcgctttaaaaaaaaaaaaaagtactgaaggtttgtggattaaaccagagctgtgacctctggaccaaagtaataaaagtccagcccatagcctggtagaagatagctagatggaagaaaaagaaaagctgcataagagaataacaacaggcccagagaggcctggagacagaggaaaacacagaggattagattttcagaagctgtggacttaagcaataaaaagtctatcaaagtgtaccttgttgatgtatggcacgtggctaataattcctaggttagccctttaagacacattgaaagatgggtcactccctaagtatgacatgatgaaatgaaactgtgtagaccatcaagcaccaggggaaaataacctgtgtgaggcttgagcttttctaagagagaaaacaagataaaaaaataaaaacaaagcccacaacacaaataaacaggatttactctacaaaacaaagctcacatttgcatatactaaggcttgttctctgcttaatcgaaggtaggaggagccagggtgattggctctctccctgagaacttgaactttgcttcagagggcagtttctagcaaggatgagcactgtttctgatctgaaaccgggataaaacataactgagtatccacagctcagagcaagaccgacaagcaagacgcatagttacagtgagtgtatgatagagctaatctgcattttaaattcgcacataacagtcttcgaaggtatgcaaaaaccgttttcaccaacaggaaaatccaaaataagtacattcgaggatttttttttccacaaaataaaatagttacaaaggttgaataaaaaattatctaagtgaaaatcacttcatactgggaatataaatctctggttctttggtaaataaaattaacaagaattattcaactagaactatcagcatataggtttctaggtttctagatgaacagtttactaactgggtcacgtataaaggtcaaaccagtttcttcgttacgactggttaaaactgatcgaataaaaaacaaatctgctatcagctgataaatactaactttaacaaaggctcagtacatgtagacatggtccatgtgtgttttaatttttaaaaggagtgaggagggaataggagaaagcaatatagctctcatcagcactttcttcccatcaggcgctttacatacagtcgctccttttaatctcatatccaccctgggaaggagaattaggacattacagttaagccacctgcccaaggccacattaacaagtgacaatggctggttctgctggatccagcctgggcctccttccaccaccaatctcagaggcatggcccaaagagacagctcagtcttcaggaacaatcaactgaatttaatatttactcagggccaggtgtggtggctcatgattgtaatcccagcactttgggaggtcgggggagggcgggggggcgggaggggtgcggggcggcgggtcacctgaggtcaggacttcaagaccagcctggctaacacggtgaaaccctgtttctactaaaaatacaaaaaattagccaggcgtggtggtgggtgcctgtaatcccagctacttgggaggctgaggcaggagaatcgcttgaacccgggaggtggaggttgcagtgagccgagattgtacctctgcactccagcctgggtgaagtgaaactccgtctcaaaagaaaaaaaaaaaaatttactcagataaaccaaacaggaagtacaaggcaggactcaagacaagttataatagaagagcaaagatcagtaagaaataaatataaataatagttacataatttacagaaaatagtcattaaactgcattcaagccaagatataaattacttagaagattctattcacaaaatattttaacttctccttgaaggttagtattgtcttatttagtgtaaatttaaagtatcatgtacgcaacaccacagaaaagatactgtctggaagctaagacattactaattaaatgcaaagagttgatatgaaaaggaagtaaaataacctagaagatggggcacggtggcaaggctgaggcagtcagattgattctacgagtcctgaagtttgaggttacagtgaactatgatcccacagcgccactgaactccagcctggatgacagagtgagatcctgtctctaattaaaacaaaacaaaacaaaacaaaacaaaaacctagaagagagtaacagcaccatactcagctttctcagctttttacttatttattttttttggagacggagtcttgatgtgtcgcccaggctggagtgcagtggcgtgatctcggctcactgcaacctccacctcctgggttcaagcaattctagtgccttagcctcccaagaagctggactgtcatgcaccatcacaccgagctaatttttgtattttcagtagagatggggtttcaccatgttggcctggctggtctcgaattcctgtcctcaagcaatctgcccacctcggtctcctcaagtgttgggattactggcatgagccactgtgccggtccatacttagctttttttagtgatacatttatactgattagtttaattctaacttgatgggaaaaaaattagtagttgggaatgaatgtataaaaatacttcattcaatagttacaattattcattacatttaaaatatccttacacctgaagggaactagaaaagcatgcctatatattctaaatttctttttctcctccacactctccaaattcccctgccaaaacagaatattgatattacaatggaaaattataaagacgatatactatgaaagttcttaatattcattcattctgagtttcttaaaatgtatagaaagatggcccaaacacctctgtgttctgcagcaggcaggtctatgcaacccacccgccaagttcgaggaagctgagctgacccatccagtctctcgaaaagaaacatttaatagggacttacggacagaagccatgtctcaggcagcagtgaggccagatagtggattcctgtgctgctacccaccacacccagggcttatataccctaggaaaggaatgtgtaggacaactgaagtccatccctagggaaaggcaagaatgctacatcaacctatgtaagggcagggtttatggtcaaggttgttttgacctaaggccaggatttatagcaacagtagataaagtaaaaatcttaagctgggcgtggtggctcatgcctgtaatcccagcactttgggaggccgaggcaggcagatcacccgaggtcgggagttcaagaccatccttaccaacatggagaaacccccgtctctactacaaatacaaaattagccgggcgtgatggcacatgtctgtaatcccagctactcaggaggctgaggtgggagaattgcttgaacctgggaggtggaggttgcagtgagccaagatcacgccattgcactccagcctgggcaacaagagcgaaactaactcagtctcaataaaaaaaaaaaaaaaaagtaaaaaagtagaggcattcccaggagttaattattagttaacatgattagcatccaagatggatttgcctggaaatggaagtgggatggggcggagaattatcttcatttgtatcacttgaggaatagctgagtgaaaacttgctgtaggcagctgggtactcaggttagactttgaagactcacttaggggctagatttagagaactgccgcttaatggctcatagtcagaagtcaaagccacattgaaattaaacagactgccataaaacagtgtggcctagttgaaagacaaagaatctgaagtgagaagttccgggttaaagtccgagacccaccattaccagccatttccttgggtgaatatttaaatctccagtctcagtttcctcgtctgcagaatgaagaacacagtctgcctccctgggagcagaaatacatctaccacttagggttgctgtgagaatgcagtgagaaaagcactggaaagcgtcttatgaagtccaagtcatgcatgagggatcgctattagcagcatgtttaatggaatatatgttctcaattcaaatgacagagactcgcatcctaaaatttaaagaaaagtaagttaaaaagtataagcctggcgcagtggctcacgcccataatcctggtactttgggaagccgaggtgggtggaatgcctgagctcaggaatttgagaccagcctgtgcaacatggtgaaaccctgtctctactaaaatacaaataattagcagggcatggccgcgtgtgcctgtggtcccagttacttggtagcctgaggcaggagaattgcttgaacccgggaggcggagattgcagtaaaccaagatcacaccactgcactccggcctgggtaacagagcaagactccatctccaaaaaaaaaaaaaaaaaaaaatgtacaggccaggcgtggtggttcacgcctgtaatcccagcactttgggaaaccgaggtgggtggatcacctgaggtcagtagtttcagagcagcctggccaaaccccatctctactaaacatacaaaaattagctgggggtggtggtacatgcctgtaatcccagctactcgggaggctgaggcaggagaatctcttgtgtaaccgtcaaggggttcaccttgctcgctgcctagacagagccgattcatcacaacaggggaattgcggaattgcaatagagaaagagtaattcacgcagagccggctgtgcgggagacctgagttttataattactcaaatcagtctccccaagcattcagggagcagagtgtttaaggataacttggtgggtggggggaagccagtgagccaggagtgctgattggccagagatgaaatcataggacccggagctgtcttcctgcattcagtcagttcctaggtgggagcacaagatcagataagccagttaatccatctgggtggggccagctgatccatcaagtgcagggtctgcaaatatctcaagcactgatcttagaggcagtttagggagggtcagaatcttgtaggctccagctgcatgactcctaaaccgtaatttctaatcttgtcgctaatggtagtcctacaaaggcaatctagtccccaggcaagaaggaggtctgctttgggaaagggatgttacaatcttgataaactgtctaagtcataattttgcaaaggtggtttcacttgaacccaggaggcagaggctgcagtgagccgagattgtgccactgcactccagtctgggcaacacagccagactctgactccaaaaaaaaaaaaaaaaaatgtaacaaaacttactttatctacatttggccacagtgttgtaaaccttctaacattctttacaacagcacctaaggcaacgacaggttcttagcgtcaaccacatcttcactttggcctacagcaaaatatatttcccctatttacccaaatggaagaagtttcccctgaattgtgtttttaaggtatctccccccaactcctctctccagatagcacaaatccaagtatgtccctagactcccaagagctgcttttatggactataaaactagcaacctagctttccacaaacatctttactgctattagtgaaaatatgcacttatgatatatgcacgcacacaagcatattcctgtcaccttacagagctaagtctacatcacggagacgtgagcacacatctcatagtgcacatcgttacacatccccccaggggctgacaggcaggggcttggttttatctttgcttcatctcttgcactttaagagtcccttgggtagtatcttttttgtgctcaggtttgatatttcttactcagtctttatgatgtctgactgaaagctcaatggctcaagatgtcctcgagggtgctaatgtttttatctctgtgtcctagcaccctgcccactctgttccctacaaatgttgagtgaattaacttccgtctgaattaataagaaatgtaaaccacttgtgataaaaaataatctatctcttccacacaaaaggtcagtgtaaatctggattctgaacacagactagattgaacaaagatttcttatctgtatcggaagcaaaactgagtatggtgttttgtacaaggaacaaaggaaatagctacacctctcctactgtagacgtcactgaaaaagtctgtttctctccctggggggatactgtaaactcagtagccagcactcaatactgttgccagaagcaggaactggaagtcatcattctaagtcgcctttaataaagcagaaaagatgcaataatgtcttggcaatgtcagttcccaaacactgacaacctaaactacatcttctggccctaggtgcttatcggctgtactgacgtgcttcacattttataatgttggtaaaatgagggaaggcctgtggctctcaaattcttgtatctgcttagctaattccaacccattattgtaagcagcaacaacagaggaaggacagtctctcaagactgagcactcatgttttacccagttacaatgctattgttctctgggtgaatcagttttaaagtaaatacatttatggctgggcgcggtggctcacgcctataatcccagcactttgggaggccaaggtgggtgggtcagttgaggtcaggagttcgagaccagcatggctgacatagtgaaaccctgtctctactataaatacaaaaaaaagttagcagggcatggtggcaggggcctgtaatcccagctacttggggagctgagacaggagaattgtttgaacccaggaggtggaggttgcagtgagccaagatcgcaccactgcactcaagcctgggtgacacagtgagactccgtctcaaaaaaagacaaaaaatccatcttcaatagaggcaatgtggtgcattacaaaggggatgagtgaaaacaggctggcttcaaatgcgggttttacactttaccaactcagtgatcttgcccaaaatactttgtctgagcatgtattttctatcttataaaaagagatatatgccgagcacacacctgtaatcccaacactttgggaggccgaggcgggcggatcacctgaggtcaggagttcgagatcagcctggccaacatggtaaaaccccatctccactaaaaatacaaaaattagccaaacacagtggcacacatctgtaatcccagttacttgggaggctgaggctggagaatcacttgaacccaggaggcagaggttgcagtgagccgagattgcaccaatgcactctggactgggtgacagagccagactccatctcaaaaaaaaaaaaaaaaaagagatatgaaggaggattaataagacaaatgtacataaaatatttcacacaggcccacatcatgaaatcccagatgttagtcatacatcatctgcctaagtctttgaatatttggggcatgcaaaacaaaccaaaaaggagttgcctattgaagaaaaggcaaatgtcttgacatgatgttcagatcttatgtgattcttcgccatcttacgctagcaggttgatgtctttgtcttcccccacagctctactccagttgaaccggggtaggcgtactctctaagctacttcatgtctctccacttccagaagcttcttcctgctggtacctctgtccccatctctcaggactccatctgccatgaccctttcatgattccactgagaagttacttttctttttcccttctttgaacatcgaaagcatgctgtgcctctttacggtagttcttttacaacttggcacggtgctttgcaatgtaatcacttgattacaagtttcattttcttcattagaccgcacactccttgaagtttatatggctttattttttgcacagagtagttattcaatatacactgactgaatatattttaaaacttcagggagtaattaaatcagccaaagtaaatttagtctacacatacatttatagaatgtacaccatctccagcctcagacaactgcactcaagttgcccctttcccgagccactttctggctaattgctaaacatgtttccaccagatctgcccctccagctgcctgcagctccagtagaggctgtgtggagaagagccatgcagactgcatctgtaaggtcctgcctgtgcactttccgcttcccaaatgaggacagagagcactcctgccagctaccaggcagggcccaatttctaaactctgccttgaccccctgccttcccatcagaggagaagcatccttacctaagaacactacttcttcaatgaccagtcttccttccccagttctcttccttccccagtcctcttccatccccagtcctcttccatccccagtcctcttccatccccagtcctcttcctgggggtatgagaaaaaactcttaacaggtgctggctaaagggaagcccagggtctccaagatctatatctcaccagagtccttcacagcagtgccagtcggagttggctgtgttcatgttccccaagctatcacttgctcggtctttctgcagctcagaggggatggctggactaccaatcctaatgggttgggacctttctgcaaactccagtctccccatctgccctggtcctgccttgttagacagttctcagtttgagttcagataacttttagagtccctggttcctattataatacttaatattttgtccaatgtctttcttcatcatatatatgcatatatatgtacatatatacctgaaaatacacacatatataatgacctcatgcaagatcatctgtctctcagagtacccatttcctatatatgaatagatggtgtgtgtgtgtctatatatatataaatcaaatgactgttttgtatttatcccactcaatcatccatattcataaataataatatttctctagcattccagaatcaaagttaaaatatggcatgaggaccaggctcactgcctcatgcctgtaatcccagcactttgggaggccgaggtgggcagatctcttgagctcaggagtttgagaccagcctggcaacatggagaaactccctttttaccaaaaatagaaaaaattagccgggcacggtggtacatgcctataatcccagctactcaggagactgagtaggaggattgcttgagcctgggaggcagaggttgcaatgaaccaagatcgcaccactgcactccaacctgggtgacagaatgagaccctgtctcaaaaaaaaaaaaaaagaatttggtctgagcctggtcagcactggtctgatgtactgaaaaccatctcctaaacttctctctccaacaacaattaagtaccttatttacacatcaaactatagcaaaaacatcaatgacaagtacaacatctgactgttccatgaagatggtaggactgttcccaaagctttctgcttacaacttaaggccaaaccaaagagccgtggttctcctgcactaaaatggtttcagcctatttccagtcatgctgctttactaacaaactataatgaactactgtaaaacatgtgtgctatacttcactcagcaatgccttcactataagatgttgaaaatctgtgtttctggatgcataaaaatgacaagcagaaggtgttattttctattctaagggtccagaacaaaagaatgtgctttcattgtgactaaggaagtattctgcacagaccaatataatcttctactcacaatgtttccagttcctttgggtacctggtgtcattttagctctgagttatgtattaaggtcacctgctttaaaaaaaataaagacaacacatggaactcagtagagaaagtgaagtttcttgctgcatctccttcgagccatcttccctgcttgtctgtagggattccactgtgctatctcacctacctacctactcctctcattgccatcgatgctgtgataccggcaaacttctttatggctaggccttgctgtcagtgagtttccttaatgatgaaggtctctgctacctgagcagaaaagctcaagctcagcttggtccatgacattcatatgtggagtgtcatgagtttacttttaaagaactgcaagaaatatgaataaacacatttttttgaagcctatgttcaattacagcacttcaaagatgctgtaggaaaagctgaagtataacacagcatgcaaagatgcattgatttctttctccaaatcacatgtaacatatgtaagtctatacatatatgcatacatatatatgtacaccaaagtttaagaaatagatggttgttgaccaattgtatgtttttaaagagttttctaacaattatattagatattttataacttttaaaaatttacttcgaaaagattctcataaatctcccagagaaggcttagaaggctggcttcaaactccagttgcctgaactaggtacagagaaggctgagatgacagcagtttctagccctggctgcacatcacagtcacctggggagctttcaaaactattaaacagcaaaatatctgacacacagtagctaatcaatacacggaaatttctctgttttcccttccaccctatatccaatcccatatttcccaaaatgcctacagagcatactctgccatctcactagcacctcactccgtagcctaaagcttccaacaagtatcaccacatgttcccgcttctttgctcaggcccagtgagttgccaggggtttccgcatcacctatattttatgcctgtttcttcctcgtgttccctgtcacctggcataatggtcttgaactgtcttcccactttaggcccacagtttcctccctgcagcctgggggatctctccacagtgcacgtgtgatcgcatctttcccactgccacctcctccaaggcaatctgccggcagggatctccctgtctctgtacttctgtctccatgttcccctttctgggaccctatattgcaggcaaacagaatcagacagaatgtgtgaaatagatgactcctgcaatcttgtcctgtccctatttctacatcagcttcctgtagatgtttcctctttcccatctcctgttctctccaccagcagtgtccatctccatgtcaactgttcccttcccaaggcccttgtcacttatgtgtatgtgggatgctttaatatttataggaagacttgtgttggtgaaaacacaagtcatcaggttcattgtgggatttattcaagggcttgccttctctcttaagtctacatttgtggattctcttcttaaactacattaccccaaacacccagtggacagctacgacattattgttttgttttgatactggtataaatatagtcatcttctcaactgaatatatctcttccataaaaattcatgtaagagcaaaatataatttcaaaagtcaaagttggaaatacccaaatacctcggcgggtgcggtggctcacgcctgtaatcccagcactttgagaggccaaggcgggtggatcacttgaggtcaggagtttcagaccagcctggccaacatggtgaaaacctgctctaccaaaaatacaaaaattagctgacatgatggcacaggcctgtaatccaagctacaaaggagactgaggcaggagaatagcttgaacctgggatgaggaggttgcactgagctgagattgtgtcactgcactgcagcctgggtgacagagccaaactctgtctctaaataaataaataaaattaaaaaaaagaaaagaagtatctaaatacctaaaggcaacacaacttaaaaaaccatcattattcatcatactaaaattacatgtcttcatgaaaaacaagtggcagaaagtttggtgtgctatgtggtgcagaaattcatccagtagtcagtcctgcccagactgattccatgtttttgtattttctcatagctgaaaatattaaatccagacagaatctctgaggcaacgaccgcgtgtgggaagtcagcctatttaacttgagatcaaccgatctacagagtatgcacatggctctcttgtaaagaggtgagaaaagatttcaaaaagcactgtcgtcagcagaaaggacctttacagccagatgaagctctggttgttttcagccactttcctctgctggggaaaaggcacattaaaaagacacagctgtctatttcagtgtacacatgcttggtagcatgggtgttatttactgataaaaagcacatgacagcaattttaaaacagggcttgtcctgtcagtcaaattagagaggcaggatgtcctctccaagtgattaccgtgggggcccacaatgtggcggcctgccaggtcaattacagcagggctgtgaggacacatgaagaaggatcgccttaattctaaacaggagcatcagtaaaatagaaaccaggggacatattaacacaatgaacaataccttaagactgtggctttggctagagctgtaaaatgtatttatattgagtgtttctccatgtaaacattttttttttaattaacgagaatgaatgtataggaatacaattgcaaaataacatttgtatatttctggagaaaaacatttctcaaaggaaaattgggatgctataattttcatctcatcaagaaaattagacacatgggtaaattagcatttggaaacctgaccaatgatatttcataattgttcatgtccctgatatgtcaatttgccttccatttctcctatactaagattaatttcagtttcaaatgtccttgtcattttttctcctctctattgcacctacagcttctttgtctacaggaaaaaatattaagagatcagcagcatcagttggaggatttacatcatcgactatctgaataccagggacacattcctttgttttacactcatattccaggagtctcatggaaatgcattaaacatcagacaaaaaaatgtaggctgcttgaatcgcagcttaattgtttaggaactagatcctgatagtgccccaataacagaagaaaatccctattcacatctacgtagagaaaatactgggctgctgacactgaattttgcagctatgcgaaatttaatgctgattagtaaactctcaaattaaacagtgaaagattataaagacacatgcaaaagatgtaaattaaacccaaaatatcagaaataccacagtcataatttcccacctacctaaagagttatttctcaaaaaaaaattgttgcgaatttattttattttgttttgttttgagatggagtctccctctgtcgcccaggctagagtgcaatggcctgatctcagctcactgcaacctccaggttcaagtggttctcctacctcaacctcccgagtagctgggattataggcgcccaccaccatgcccagctaatttttgtatttttagtacagacggggtttcaccaggttggccaagctgctctcgaactcctgacctcaggtgatccacccgccttggcctcccaaagtgctgggattacaggcgtgagccactgcacccagctgaatttattttattttttattttttattttttgagatagagtcttgctctgtcacacaggctgaagtgcaatggtgtgatctcagctcgctgcaatctctgcctcacgggttcaagcaattctcctgcctcagcctcctaagccaccatgcccggccatgaatttaaataaattcaaagatcccattaatgtttattacaaccccaataatataggtaggcagaatacaatcctgaaaaaggtgccaaaagttgaaacaatgtaagtcaactcagtttccccaagttaaaattataagagtatattaactggctgggcgtggtggctcatgtccgtaagcccagcactcagggaggctgaggcaggtgatcacctgaggtcaggagttcgagaccagcctggccaacatggttaaaccccgcctctactaaaaatataaaaattagctgggcatggtggtgggtgcctgtaatcccagctactctggaggctgaggcacgagaatcacttgaacccaggaggcagaggttgcagtgagccgagattgcgccattgcactccagcctgggtgacaagagtgaaactctggctcaaaaaaaaaaaaaaaaattaaaaatgatactaaagaccttagaatttctggacatatctgtccaagtatctgtcacgtgtcattctcactatacagaaaacaatctctaaagtcattgatgtctacatgtctaaacttttcaccatttttgacatcttaatacttttaaattacaatccaagttaaaagggcaatgtaggattagaatagaaagaggtgaggattcagaaatcctcacatcaatttcacaactccctgtacgatggaggcctctcttccctgattcttccttagggttttcaaacacggagtccctcctaggtgccagaggttgttctgggctcaggcagtacaatggtgtataaagctgccaaaacccttgccctcatgtggggagacagacacgaggctgagtaagccacacaatctgttaggatggtgatgagtgcgtggtgcatcatttcatatagggtgatcaggaaggcctcaagataaggtgacatttcaggaaggcctaaaagttgaggcatgcatcatgcagataactggggagagccatccagacagggagggcaaaggcaggggcacagggccaggggccagcaaagaggccagtgagaaaagggccatcctaggctctggactctactgctgctgggatggatggccctggggagttcttgcagaagaaacataagccaatcacccaaggtgactgttaaaatgaaaatccccaggcctctcaatctggacttctgattcagtaggtttgaggcccagggattaagatttcttagtttgcaggtagttcagctgagagtggcccaaagagcattctcagaaacacatttctgaatccctgatagtttggcatccctcctctatttccttatttttggtcagctgccctctacaacaagcagccatcattttgcagccgtttagcgttaaacaactaggagagagatgataagaaggaataccctaagtataagagttaaaaacgaagccacttagtttttgtctagcaagagagtctggccccaatatcttctgagctttgctgacattcagtgattggcttgtaactgacaaatggttgaattctatgagtatgggcgtcctatgactatcctggtcattgatttgactaatgattcctgtgcccttgggttgactaaaacgcaaggctgttgtgtttggtgagtttgttaaggtgaaggtcaagtcaaatattgactgcagaagtgatattacagatacccaagttcccaggttgcggaaggtaagagaattcagatgacagggattacaggtgcaaagaagtagtccaatgatcctaaatattttcagttcaagtgcttcttttagggatattacttagtatttcatctcttttcctttgatgtctagataggtattaaatattgcagcaatgaaaacaactgacatcaggtgcattctctctacattattttatttaatcctaaaatagccctgtgaggtaactactgtatgggttaaccaaagcccagagatgttacttgcccaagagtcacagggctattaacaggcagaattgagactctaacctatgtctgattaatccaacacccatgtcttaaccactaaaatatactgctccttaaatctataagaaacatacttgccataaatgttttacatacggcatttccacaagagagcttaatattgagatgctggttaattatcagagacagcgtgatgcatgaggaacactagttttggagcaaaacagatctgaggctcaaatcatttgaccactgaatagcaaatgacttaataggcctgagcccccaaaccttcattcatagagaacattatgtctctcagaaatttaagtgagaaaataagtgcaatgcatggggcatatagcacatagcatagatactaattccttccctactgacttggaagcaaacactgaccatcacctccacctccacctccacccggggcacagagcacagcactcgcgcaaacccccaacagagggtagagggtcatctcggttgggcttgggcttctgtagcggggggctcactgctccgccgagtgccctaaccactgatggacacctccagcccctctgagggttcttcctcctactgacccaatggtcgactccccccaggactgcttctctgaggcaacactgagcaaactgactgctctttcctagtgacagtgccactaataactgaagacagtcagttggtgtcccctggtctttctttctctaaattaaacatgtccacttcagtcagaagtccctctgatcacaatttccgaacaacacagtatcctaattttcctctgctgggaaaactctagtttttctgtgtcctttaatgccaggaccagggccaaaaattgagattgacatattaagccaagaatatgattggactattacataggctaatctagaaaactcaccttgataatcccaggcttcttggctaatcttagcgccttggcccagagcagtcacatcggcaaaaaattcccgcccacttctcctcccagttccacccctcacagcagctgctcacatctttcctcctcccttttttccctccgaggccctccctcagcctctgtttcatctcttcaggaatctcctcttcccagcccaatcctaaacccaggtagcctttgttctaaatttgtataagtgtgttctaagttcctcgcctccccagtcagccagtcagctcggcaaaacaaaaggaccttcccccaaaccagctctccttattaagtagaggaggagagagttctgtaatacttgtaattactcagaccctgtcacactttaagtaactcagcctaagaccattattatacctgtacttcataccgctggctgaccctgagcttgtggtcaaccctgagtcctagagctttcatcatcttaactcctgcccaggccaatagatagcctcaatcctgttattgcatacagtcatgttttggaaagctaaacaaacaaaaaaacatggcaaggtgcaggcccagcaaaggggccaatgagaagagagccgtcctaggccctggaccctctgaaaggtttctgactatgaaacctttactttcatcccaggtaagtccaattttggtttagcaaaatcaaaattcttcttgcagcttattgcaatcatttcatttttgcttctgttatctcttgtactctactagctctccttttcggatttgtaccttctgtgaatgtggtatgactttatgaggatcatggacaaaaatgttgagaagaaactaaccaaggaaaacttttgttgcatggataaatacatagatgcatataaaacaggcagtacataatggatacataagcatataagatgctcataaaataacacaaccctgaggacacacagagatgccaggtaacatcactgcactgagtctaatagtctttagcactcccacacgagcaaacctggctgcaaaatcatgttacacagcaacagaggaatgctcatagcacagaattaaatagagattctaagtcatgtgagggggcagccaggaaaaagggatgtttatgttatttaagtgacaatgaaagttaattatacagcacaggagactagaaaagctttatttgacgttgcagacttttagtgaccacagaagcagttgtaggtattaaaatttcatccatctcagtgtcatttatttactttgccagataatcagtgatcttgcatttttatcttctcactttaaatgtatgcacagaatgttctctcctatgcgatctcacatttattttattttttatttactttattgttgatttttttttttttttttttttttgagacagagtctcgctctgtcacccaagctggagagcagtggcgcgatgtcgactcacggcaacctccgcctcccgggttgaagccattctcctgcctcggcctcctgagtagctgggattacaggcatgtgccaccacgcctggatatttttgtatttttagtatagacagggtttcaccaggttggccaggctggtctccaactcctgacctcaggtgatccacccacctcagcctcccaaagcgctgggattacaggtgtgagccaccgcgcccggcctcaagttcattttaaaatctgaattgtcagctgggcatggtggctcacacctgtaatcccagcactttgggaggctgaggtggacgaatcgtgaggtcaggagttggagaccagcttggccaacatggtgaaaccctgtctctactaaaaatacaaaaaaaatgagctgggtgtagaggcaggagcctgtaatcccagctacttgggaggctgaggcaggaaaatcacttgaacccaggaggcggaggttgcagtgagccaagatcacgccactgcactccagcctgggcaacagagtgagactccgtctgagaaaataaaaataaaaaaatttaaaaaatatctgaattgtcctggtattccatccagtatcaggcttaagttgtcaagaagagataccagtcttgatttctgtgaactgccagaattacacagaaatttgctccacttcccggaaaaggcaaataaaacataccaggattttaggtggtgcaagtaagttgcttgccagagcagccatggctacatataatttgcccaattcccatcaggcatttggttatttaaattttaagcatgcttgatacagcggtcatattaaccttccttatatatgaggaaaacatttcaagttataattatgttaatggtattctaatagtatttttaaaaaattatataacatttattactccgaggaaattaatgtcagatgacactaaaataattaagtttgaattaatcacagattatatcactttgttctcttcaacttttaaacatgtttgataattataatctaacaaaggaaaaattaatagagaaaataagtctaaaaattttctcctccgaattggtaattgggggaacaaaagatgtgggcaattagcaaatgaatatggtgcttcaagactgaagaatttaggatatgtaacaggtgacttagttcagggttgttcctagaggtaagaagtatcaatagaatttaagagtctacactgttcattctatcagtatatcttctatggcacacaagaagcaatggttattcagttatcttaatttcttaagttataaaagttaaatttgagccaaaagcaattaccatgtaaaagtgtatgcagtttttttttttttttttttttgagacagagtctcactctgttgctcaggctggagtgcagtggcgtgatctcagctcactgcaacctctgtttcctgggttcaagcgatgctcctgccccagtctcccaagtacctggcattataggcgtgcgccaccaggcccagctaaatttgtatttttagtagaaacagggttttaccatgttggccaggctggtctcgaactcttgacctcaagtgatccgcctgcctcggtctcccaaagtgctgggattacaggcatgagctacagcaccaggtcggtgtgcagttttgaccttgttatttgaccaaggaaaatttagccatttgaaacaaactcttttttttttttaagactgagtttcactcttgacaccctggtgcgatctcggctcactgcaacctccccctcttgggttcaagctattctcctgcctcatcttcccaagtagctgggattacaggagtgtgccaccacgcccggctaatttttgtatttttagttgagatggggtttcaccatgctggccaggatggtctcgaactcctgacctcaggtgatccaccctcctcggcctcccaaaatactgggattacaggcgtgagccaccgcgcctggcccaacacacactatttcttacattaacttgatgtctcctttcacctaacagaagcaaaatacacgcctaattgaaagacagtcagtgtgtcagactgaaacaaccaccaccaaacaaccaaggcactgatcaggaaaacagcacttttcccttgattctgactttttttctcacatacctttatttgcattattcataggttttatcagaggtttatttccttgggttaataatgaaacatttttcatttgtttccaccaaggggcttgctattctactattgcttagagcttcgggtgtctccatatgacaaatgccaaacatatgccaatcacaacattcaactggtagcatatgctgaatttcccagacgccagatccagtcaggaactttctggtttaatgagtcttgcctattatgtttctggtacacatcattacagaatttttccccatctacttccaagaactagaataaaccagaagaacaaaacaaactacaacaaaaccataataaatcctctcttcgtttatcatctatatgtcacatacgaaattagttacactagcagcatttactgagggcatggcaagatttactaagtcttgtttctcatgttacagccaaattttatcaaagttgaaaataacaatattttacatccatatagttctttgtattatttatttcaaaggactttcagaacttttacctaattggatatttacaaaaacccgtcgattgaagtaggcagcaattctttctcccacttaatagaggagataaatgaagcccagataaattaagcagcgctcccaatgtcacagttagttattattattatattattttttgagaaggagtttcactcttgttgcccaggctggagtgcaatggcacaatctcagctcactgcaacctctgcctcctgggttcaggcgattctcctgcctcagcctcccaagtagctgggattacaggcacacaccaccacaatgggctaatttttgtatttttagtagagacgggggtttcaacatgttggccagggtggtcttgaactcctgacctcaggagatacatccactttagcctcccaaactgctgggattataggcatgagccaccgtgcctggccaacagttattaacagggccaagatccgataagaagttgccttgaacctcacatccactggtctcccactattcctcattaggctgtgccaaggacacaaagtcagcagggatcgagacaccattaacctccctcctgacactggaaggtggcccctacttcctctctgagttttttgtttttgtttttgtttttgttgagacggagtctcgctctgtcaccaggctcgtgtgcagtggcgcaattttggctcactgcaacctccacctcccaggttcaagtgattctcctgcctcagcctcctgagtagctaggactacaggtgcacgccactacgcccagctaatttttgtatttttagtagagatgggtttcaccatgttggccaggatgatctcaatctcttgacctcatgatccgcctgcctcagcctcccaaagcgctgaaattacaggcgtgagccaccgtgcctggtcctctctctgatagttttttaaacattcagaaaaatgtgaatgcatacttaggtttctgcctatatttcctgagagaaaatcatgcctcaacatcaaacgcaaagatcagtcttaaatctggacccaggaacaggaattctcctaattaagcacataatcccatttatctctctagaaacaactgacattcaaataatgcttcatttcgtttgtaaatactagttagatggattgtaatacaaaccaaagagacattaatacaattgtccatttcctttggaaggatggctatccttcctatttaagctaaaagacattttcatttgaaagccatttgagcttgagctgcaatgagctcaggtgcaaatttcttgatgaacgagtctaataatgacacaaaatttcaaaaagaccaagagctatttcatggattatttcctgtggcaatcatctcaagttaaataacttgacattttagaaatggcattgggtaaataactctcgggtgcttttttcactggtccgctcactccccttatcttcctgctgactaaggaaggtaaagggtatcctccacaggaggtgggaattcttggtcctttgaggtaaagggatttcccatcatatcgttccatctgaggctgttatggactcaatcttcccctcacatttatatgttgaaatcctgcccccccaagatgatggtattaggaggtagggcattcggagggttattagggcacaagggtagaaccctcatgagtgggattagagatcccagaagctagctctgcctccttcctcagtgtgaggacacccccagaagacggccatcttcaacccagaagacggccctccttcaaacccagaacttgcggacacctgacttccagcctgacttccagcctccagcagtgtgagaaatacagttctgctgtttataagccgtctatggtaatttgttacagaagcccaaactgaccaaaacacaggtttctatgaagtttgttttgagaaacagaaaaatgcttggtagttctgctattggttatcatttctcagacattataaaaattatgtcaacagcaccctcgacatgttatctctggacaaactgatgtgcttctagaattttgaatttatttacttaacttttattattagcgattagtttctacacacgtttgcaaagacggataaaatcagagccctaccattgagtagataacagcctagcaggggaggtagaaagacaaaactaatagtaatagaatgcgataatctttttttttttttttttttgaccgagtcttgctctgtggcccaggctgaagtgcagtggtgcaatctcgactcactgcaaccgctgcctcctgagttcaagtgattctcctgcctcagcctcccaagtagctgggactacaggcatatgacaccatgcctggctaatttttgtacttttagtagagacgaggtttcaccacgttggccaggctgtctccaactcctgccctcaggtgatcatctgcctcggcctcccaaagtgctgggattgcaggcgtgagccaccgcacccagccaataatctctttaatagggattaatgtaaaacaaaaagaaaaagccacacagtggatgatgaagctaaatatgtctcaccgtttgtctggtgttttatagaggtggtaaaatttcagttggtggttcctaataatatcaccttcacaatagaaaataaagatctatgtgcagataggttaaggttactccagtgatcaaggtagtgtaaaggataaagtaagaatgataataataatgagtatgtagctaaaagtcaaggattgtaaaatatcacagtagcttcggcctttaggtggaacgaagcctgtcttaggtaggatttcctagaagcagacactaagtggaagtgaattattaggaagggctgtcccaagggagaaagaaatagagcgtctgggggctagacagggaaaggaaggaagcccaacaagggtgtgtcattaggtaaattcttatgaagggttattttggctcattgctacaagagaactctagagacacttctcagagttgtcccgtttgggggatgggcagatgatgagagttgggagaaggaggagctgaagtaaacacccccatccttgtcagtctttggttaaagactctcctaggggtatgtaagtcaccaggcgaggctgggctctacagctacttggtaaagtttctgagcagtacagcatctgttacaggcccatttcagaggagttggttctagagtctattttattaatatctaagcatatgttaggttttaaacagaaagcgtcaagtctctggtggatgtgcaataacatcacaccatatttaagttcttacaaagatgtagaaggaagatgtgggtttcagaaatgttctggaaactagaaacacttccctgtgtgtcatgctgcgacggtgccatgtcacgcagcccactggagtggcgtgtgaggtaatgacattgacttcaggtcctggtgagaagactattgctaggaggcatctggctggctggtggctgctcatatcctacgcatacccacctgacagatctctaggattgaaacagagaatgtatgtatgactaagcataacagcaaattttcttctgtatgtaatttcaagacccttcttatcatctctcttagtgatctagtgatctgatgcttgtaataggccttcgtgaatattcctcacttcaaagtagtctgtgagacacacatacaaacgagattctattaacaggtctgccagtgaaacagcccaagtagcaaatttgatagagaacacgtacttgggcatacaaatcccaaaactatgtactaattccaccaggtataaatctcacccaccagaccaacgtctgaaaactatacccaatttccagtccataacaagttaaatggaatttaaggaggttcgttaaagtgttataaacttacaatataagagctacaaaagaatatcataaacaaataatgagaataactccttttctctaaatatacagttattcagagatttcttttgttcttagagaattgttgtcagtcttcctgattataaaaataaagtcttgttgcagaaaattaggcaagtacttcttagcatttttcccttttcctttttcttttggatatgccgttttattgaggtgcaaccatatataaaaacatacacaactcctaagtacatggttgagtttttataaagcaaagaaacctgtgtaagaaccacccagaagatggtttggtttctgttgagggcagagtaagttcatacagaagctccggcctcatcgttgtaacatgtatttgtgagctacttgaagaaacagaccatttcttctcttgtcctccacaatccttgaatatttcatttgttttggagattgacagatcaagttattcattcattaacaattattaatccctactatgtgctcagcagtcagtgtgtgatgatgagacttggagtctagtggaagacacaggtaatacagaagcaaatatacaaagtgttcactataaaatacaaaatgctagggaggaaataaaactgatactgtggtcaagaataactaggtatcctacctagaaaaaatggttagagaaataaatcagagatgagatttagatagaaacttgaataaaaagaacacagccatgagaagagagaaggaaaacacattccaaacaaagggaacactgtgaacaaagtacacaaatccggcttgttgcacaaatggaaaatcaggtgactaggcgttggtggccataggtgtgagtcggacagcaaagacagagaccaggccagtcatggctatactggccaggagagtgacttaaagtgctaagtgcaatgtagggggaaaaaacggggttttagcaggaaagtgaagggaccgatctacgttttaataagagtaccttgaacactgtatgagcgggtggcgagagacaaagcaaggtgccggcaggttatcgcggtggcaatggaagatgtactctggaggtatatcaaccatttctgtggatggattggatgtgggagtgtgggaggtgcagaatcaaaatccatcaagtctttttacttcggcaattatgtggaatgagttgtcattcactgagatggagaagattcatggagaaataagtttccatgaaaaaaagcaagagtttagttttgaacatattacatttcagatgtttgagaaacatccgcgtggagttgtcaggtaagtaatttggataaatgagacgggagtgctgagaggagagctgagctggagatataaatttgggagtcattagcatatagatggtttctaaagccatgggaatataactcaaggagaagatagagaggacgtggggccaagctctgaggaccttcaaccttcagaagttgttcaggttcaagccagaaaaggctcaaaacgctaagcagaaagaatcgtagatgtaggagaaaaaccaggtctcagaagccacgaaagcagagtttcaaccagagggggtggtccacagtgcccagtgctggagagaggctgcgtaagaacaaacgagaggagcatctaactgggcttggcattgcccaaagctgttggtgatgctgtctcaggggaggaaagattaaatgggaagggaaaatggggcaagaagtgaagtgagtggggtccaggtaagttctttaagaggcagacgctcttacaacacaatgtgcattggggaaatgagagaagacaataaaggagagaggggaccagccaaaggaacaacctctttgatgaggcagaggtgggtgtccagcacaagtggaggcctttgcatctaagaggagaaaggacgctttttctcaagaaatggaagacaagaaagtgagtgctcttggtgtcaccttcttaaattgcagtaacatataaggcaaagtgagcagccggaaagaaagaggcaggggagggtgggaggagtgggaggtcttattagaagcaagggatagatatagggggggtgctgtagagagtgggagctcatacctcaggaaaccgggtactgacaaggagggaagagccatctgctgatgtgaacttacagtgtcctcggtttacccaaatgtttactaccaaaaaaaaaaaaaaacaccctaaagcttcaagggaaagaaactaaaacacagaccaccacagtcatttaaagctatgcatttgctcaggaagtgcaataaaaagcgtgtgggtaactgggcgtggtggtgggcacctgtaatctcagctactcagaaggctgaggcaggagaatctcttgaacttggaggcggaggttgcagtgagacgagattgcatcactgtactccagtatgggcaacagagcaagaatccatctcaaaaaaaaaaaaaaaaaaaaaaaaaaaaaaaaaaaaaaaaaaaaaaagggtaaaagtgagtggggaaaaggcagctgaaagaacatgagtgaaatgatgaactttggaatctcaggtggataaagacaggagtcatggcaggagggctggggaaggagagaaagcggcgagggactcccgtggaggttaacacagcaagggctctgcaagcaccgcagctgtcgctggagacgcgaatgcttcattttgttattttggaggtgaagtaacatctagttcgactctgttacactgagagtgttcgatgagaatagagtagaagaaaatgtcactgaagatgagcagatcaatgaatgaagatacaggatactgaggggaccattcatgtaaataatgagttgccaagaaaacggacagaatggccaggcgcagtggctcacgcctgtaatcccagcactttgggaggctgaggcgggcggatcacctgaggtcgggagttcatgaccagcctgaccaacatcgagaaaccccatttctactaaaaatacaaaattagccgggcgtggtggtaatgcctgtaatcccagctacttgggaggctgaggcaggagaatcacttgaactcgggaggcagagtttgcagtgagccgagatcgccccattgcattccagcctgggcagcaagagcaaaactccatctctaaataaataaataaaaaagaaaagaaaacggacagaatttggagaactgggggtggcagacaggacagataaacatcctcagtgaggtggcggggggcaggaggttaacagatgacagtggcaacacggggtggggggagcacagcgcagcgcaatggcatgaagatcaggggcttttactagagccatgggaatggcagcttggctggtgttgaggaggaagcatctcatggccttgccggagccaggcgtacattgggacggcctccagagaaggcgaaagacccagccaaggccaggtcaccacagaaatgttctaaaatgagactgagaatttaacaatggggtttgtgattgtgggaaaaattccaaaagcagagtgtatcaactatcaagaaaaatgatgaaatatacttatttggggggctttatagaaaggaggaattctgtgctacacctattatatatctaactcaaaagtcacttattcagttccttttatacgcaatggactatgcttctaacagacttttcagccacatgcaacaaaaaaccaagtaggaagggcccataggttggtgcacaggtcagtatgtgataccccaacgcaaacacatggtaaatgactggcaaaagtcaataatggctatatatattatatatggaggcatttatacaaagaggaatatatagaaggaggaatttaaaatcatgtctagagtaatataatagatgttaacaatcatgataatagtatttcaaagtatattaaacaaaatggattcatttctaacccaaccagtaaaatattctttgaaccaagattttactaggatgccaaatttaaaagttaaaaaaattccagctttttgagtaatgagcaatttcagtcatcaataaaattaatgaaaatgagagagcaaattacactaatccattgggtaaagaaaaacttaaaacattacccaaatagaagctttcttttctattgcttttcatcagtaataggtatcaactacatttaacaaaaacactgttgctgagataactcaccctcttggtttttaaatacactcaagatatgtcatgtttcaataaatgatgtcagcgttacactgtgtgaaaaaaatacaaaaaaaaaatttaagtttcatctataaatattattccattgacatttcataattaaagtttctaaagaatgaattcaaggccggtggctcacggctgtaatcccagcactttgggaggccgaggcaggtggatcacctgaggtcagaagcttgaggccagcctggccaacatgataaaacccagtctctactaaaaatacaaaaactagctgggtgtggtggtgtatgcctgtaatcccagttacttgggaaggcgaggcaggagaatcgcttgaacctgggaggtggaggttgcggtgtgccgaaatggctccagcctgggcaacaagagcgaaactccatctcaaaaaaaaaaaaaaaaaagtgagaaaacattggagaacataacttgattgagtgagaaggaaatggcagcttagagcagaccctgaaagcagggaggcagctagctgggcctgatctcctgctgcagaaacaggcaatacatccgtactgtgtgaagcccctaagtttgtcactatttgtcatgcagaaacaggtaagtaagacatattataactcggaaaaaatctcaaacctgttgcacaagaagttatttaccattgtaagctctctgcgaaatgttttggaaacccaagttgagaacagctttgatcagaggcaactgaaggcgggcagaagaaaccaagcagtaactactcagctggtgtgtgtgtgtgtgtgtgtgtgtgtgtgtgtgtgtgtgtgtgtgtgtgtgtgtgtgtgtgtcagtttggcagacgccttctttttttttcccctctagtgcatcatgttgaaactgtagctaatgccgggcgcagtggttcacacctgtaatcccagcactttgggaggccgaggcggggggatcacgaaatcaggagatcgagatcatcctaaccaacacagtgaaaccccttctctactaaaaatacagaaattagccagatgcagtggcgtgcacctgtagtcccagctactcaggaggctgaggcaggagaatcgcctgaacccgggaagcagaggttgctgtgagccgagattgcaccactgcactccaaccaggtgacagagcgagactccatctcaaaaaaaaaaaaaaaaaagagaaaaggaagctgtagcttagaacaggagaatgcaagtgattattatcaggaattgcatctgtgagggaacctgaggactcaagccagcccagcagagggcaaggcagcacagggcatgagtcattctcctgatgctaccttcacaggatatcagacaaaggaaactgagcacctgccccatttgatgaaataaagcagataaaagataatacatttaaacaattagatgtgtatcttttatatccaagcaatattgtacagaaaggcaccacctctaccttatgacaagtgttactacccatactcaggaaaccccgatgttgccagcacagaagccaggacaacagaaagctgaacaattccttttgcccaatgtgaacatctccaataaggctccagtttggaagacttctgaaggcctttcaaattcataataaatgctatgaactgccacacttaatcccctgtattctggctgggccagctgttataatacaccaccccacagtcattgctgcttggtagtcgaacaaacacgctggagtcagaggccagagtccttcctcatgccaccagcttccctgagcctagtcccaacaccattccccccagggcactttgctgtggcctcactgggtgtgcccacgtggtcttgccctgaaccccaatctgtaatcagcaccagctcttcaggcgttgaccataaaaggcactgaatgatggtggtgtttttttgttttctgttttctgtttgtttgtttttttgagatagagtcttgctctgtctcccaggctggaatgcagtggcatgatctcactacaacctccacttcccaggttcaagtaattcttatgcctcagcctcccgagtagctgggattatcaggcgcccgccatcacacccagctaatttttgtatttttagtagagatgaggtttcaccatgttggcctggctggtctcgaactcctgacctcaagtgatccacctgcctcggcctcccagagtgctgggattacaggcgtgagccactatgctcggcggatggtgctgttaacaacagtatctatccttgacaatatagggcttcttctgaccacctcaaagatgctactgcatcaggctttaccaaattcttctcttgttacatgagtttcagctcaagaatcagatcatgggggaagcttcaagagcagcaaaacttgtaatttttgcccagttgccctacaagaaaataaagttttgactcttaggcataatcaccatggtgagaacctatatattaatatctacacacaagtatctatatctctccttttaaatatactctttagatggctgctccttacgacaaaggttttatttggtgatttgatgataaaaaaaatcacttttctttatggtgactattatgccatcatctttactaacaagtatattatcaggaatctcaaagaaagtggcattcatgttatagccttcattacttcaaactattccggattccccatattattttacatattttcactgacttttaagcaaatgctttaattttccctttttttttttttttttctgagacggagtttcgctcttcttgcccaggctggagtgcaatggcgccatctcggctcactgcaacctccgcctcctgggttcaagcgattctcctgcctcagcctcccaggtagctgggattacaggcatgcgccaccacacctggctaattttgtatttttagtagagatggggtttctccatgttggtcaggctggtcttgaactcccgatttcaggtgatctgcctgcctcagcctcccaaagtgctgggattacaggcatgagccactgtgcccagcaattttctacttttttttttttaatttcttagatggggtctcattctatcactcaggctggagtgcagtggagtgatcttagcccatcacagtctctgcctccaaggctcaagcgattcttctgcctcagcctcctctgtacctgggatgtgccacaggtatgtgccacacacccagctaatttttgtatttgtggtagagatggagttttgccatgttgcccaggctggtctcaagttccggagctcaagtgatctgcccacctcagcctcccgaagtgctaggattacagcatgagccaccgcgcccagccaacttttctactttaaaaaggcaattggtgaaacctcttctctactaaaaaatacaaaaaattagctgggcatggtgccaggtgcctgtagtcccagctacttgggaggctgaggcaggagaatggcgtgaacccaggaggcggagcttgtagtgagccaagatcgtgccactgcactcctgcctgggcgacagagcaagattccgtctcaaaaaaaaaaaaaaaaaggcaattggtaagttgtatgaacattttgaaactcaaacatttttgtgttaccaggaaattcactatagagagaatgaaaactacgactatttgtaaataatactatgacacagactgcgacaggccactaggctgatttgcaggtaaaatttttgttctatcaaaaccttaaaaaccacatggacacacacacagccttccccagcccctgccatcccatcacacacccttccccagcccctaacatcccatttgtggatgtaactgacatataggaagacagcccatagttatcatttaggttcaccttgtccctggaattgtgctacataaagaaactgagaagcatttctacaagaaagctacgggtcacttgtgaaaagccccaattcatcccagctgaggcatttatcttgttggaatcactggtaaaagggaaagccttgtctcttaaagactttcagttatagaggctacataaaaagcaatggccaccacaaagcttaaacagataaactatccattttgtgtcttctcctatacattagtaattacttttaaaaacatctccacctgtaccttagcctcttattcctcaccagtattccttaccaataagcaacacatatcctactgatattttgttgatggagatagaaattaaataggtggctaattcttcttcacatacgagaaaggaaagttatggaatgaaaatgatgtctctaaggtcctaaatttttcaaactagtgccacctaatctgtgaccatggctaaattctcttgtctcagctttcttccatataaaatgagttgtctaacaaacagtaagctcaattaacatctgataccattattattaaactttttctatttatatgtatttcattctcagttaatatgatgacagaaggggataaacataacttatcaacgacattaatatgacttctttcccctactacattcgttaataaagaggttataattaggtttcaaagacagcatttcattaaggtgatttcattcagatacaactatttgcatataagtgcaataaaaaccttagaagtttctatttgactatgttagcttcataagtagaaataatacacatgctttatgcttaggttaaaaatcagcctaacaatatattcatgattagttcaaaagagcagacatcaattacctataagtttataactgtcaacacataacaattacaaattagaaacagagtaatcaaagtcaggtcataatcaatgtccagaaggtcaaagacatgcagaggccaaatgcatcttctaagtgttgcctggatcaatgtcttatattttacaagtgtaaacatggaaaaatcaagttatttttaatacacttaagaaatgaagtgatttttaatacatcccatatagtaaaaacataaatttgaactaatgtcataacacccttctggtgtccttttcattaaaatgcactaccctaatcatgtttacaattgatatttctctgaagtataaattacagattgtgttaacaaatttgcaaaatgtggcaaaaatatccattgccaacatatattcattcaagtcaatcagtgtatacttaatgagtgtcttctttctccagaaactttactaagatggaaagaaggctttcaattaaagcccagagagagagaggcaaaaaaaaaaaaaacccaggtcattataaaacatgaaaatctgtgaagttataaagatgcccactgggtatgagggtgataacagagatcatttccaggtaacagaaaagactttataaaagggtcatgtctgagttgagccgtaactgaggagtatttgaccagatgggactgaggaaggaaagacgatttgcagcctaggcgatcaaaggagcagggcgacggggagaaatccatggagcgtgtccaactacagtcagtctggtgtgagatgctgcagtcccaagcgcatggagtgatgaagataaagctgaggtctccaggttgcggagagccttaagtattaaggggcttgggctttattctttgggcaatgatatttactaaacagtttcaagcacaggaatgccatggtcacatttttcattgtaaaagaacatgcttatagcagtggagtagatattgaagagaaagactgagcgaaagaagaaagccaatgactatctagtttttaaaagataatctagtgagatgcagacaagatggtagaatagaaagctccaccgttcgtcccccgaccccgcaaggacaccaagttaacagctaatctacataggaaaaacaccttcttaagaaccaaaaatcaggtgagcactcatggtacttgatttccacttcatatccctgaaagaggcactgaagtgatttaaaaaaacaaaaacaaaaacaaaaaaaacccgtcctgaatctgctgacaccacgcctcccttactgggggcgaagagcatctctgggcactaggggagggagaacacagcaattgtgaggcattaaattcagtgttgtcctgttacagcagaaaggaaaaccagaccaaactcagctgatgcctgcccatgccagggggaatgcagatccctgtggtcggaacttgagtgcctgcaaaccttgccacagagggctacagcactctgagtctccaggtcaatgtgaaaggcagtctaggccataaggactacaactattaggaaagtcctagtgctgaactaggcccagagacagtgaactgggggtgggagggcacgtgacatactgagacactagctgggacagacaagggagtgctggcatcactgctcccctaatcccaggctgcacagttctcagctccagaaaagaccccttccttccacttgaggagaggagatggaggagtagggaggactttgttttgtatcttggatactagcttagccacagcaggaaagggcaacagactgaattgtgaggcctctgttctaggccccagctaccagacaacatttctagacacactctggcccacaagggaacccactgccttgaaagaaaggagctggtgccagcagcattcatcacctgttaactgatgagcccttgggtcacgaataaccagcagcaatatccaggtaccacgtcgagggccttgggtgaggctctgggacatgctggcttcaggtaccagcacagctactggggtccaaaatgccaagtgtgctcttggggtccccagttccaggacttgacccttggatggcatttctggacctgccctgggccagtgggaagtccactgctctgaagggtgagtcccagaccaggtggcattcactacaagctgacttaagagcctttgggccttaagggaacatcagggctagtctggcagtactcctcatggtctggggtagtggtgattacagggtgaggctcctctgcctttggaaaggggagagaaaactgggaaggactgtattttgtgttttgagtgtcagctcagcagcaataccaggttgatgtctaagacttttgactctagttcctgacccccagatggcacctctggacctacccagagagcctggcagacctcactgccctgaaggggaaaaaacaggcctttatcacctactgattataaaaccccagggccttgagtgaacataggcagtagccagggagtggttacagcaggacttgggtgagactcagccctttgttggcttcatgtctgactcaacaaagtcatagtggtggtggccacaggggtgcttgtgtcactccacctcaagctttaggtggctcagaacagagagagagaaactctttgtttaagagaaagcaagagagccgggcgcagtggctcacgcctgtaatcccagcactctgggaggccgaggcgggcggatcatgaagtcaggagatcaagaccatcttggctaaagcagtgaaaccctgtctttactaaggaatacaaaaaaattagccagacgtagtggtgggcgcctgtagtcccagctactcgggaggctgaggcaggagaatggcgtgaacccaggaggcggagcttgcagtgagctgagatcgcgccactgcactccagcttcggcgacagagcgagactccatcttaaaaaacaaaaaacaaaaaaaaaaaaacaaaaaaagagaaagcaagagaagagaacaagactctctgtctggtaatcaagagaattatcacagatcttgtccaagaccatcaaagcagcacctctatgagtctgcaagaaccacagcattactgggcttggggttccccctaaagtagatacagcttagatcacaatacccaagtcctgttaaatatctagaaagcctttctgagaaagatggctacaaataagcccagacagtgaagactaaaataagtacccaactcttcaatgcccagacaccaaagaacatctgctagcatcaacaccatccaggaaaacatgatctcatcaaatgaactaaataaggcaccagggaccaatcctggataaatagagctatgtgacctttcagacagagaattcaaaatagctgtgctaagaaaacacaaagaaaattcatgataacacagagaagcaactcataatcctatcagatacatttaacaaagagaatgaaataattaaaaagaatcaagcagaaattctggagctgaaaaacacaattggcatactgaagaatgtatcagagtcttttaatagctgaactgatcaaggagaagtaagaattagtaagcttgaatacagactatttgaaaatacagagtctgaggagacaaaaaaaaaaaccacaataaattatgccttgcctacaggatctataaaatagccttaaaagggtaaatctaagagtaattgggctgggtgcggtggctcatgcctgtaatcccagcactttgggaggccgaggtgggtggatcacagagtcaggagatcgagaccatcctggccaacatggtgaaaccccgtctctacaaaaaatacaaaaattagccaggtgtggtggtgggtgcctgtaatcccagctagttgggaggctaaggcagaagaatcgcttgaatcagggaggcagaggttgcagtgagctgagataacaccactgcactccagcctggcaatagagcaagactccatctcaaaaaaaaaagaacaaaaacaaaaaaaacagtaattggcctattggccttaaagagaaaataaaggacaagataggggtagaaaatgtatttaaagggataataacagagaacttcccaaacctagagaaagatatcaatatacaactacaacaaggttacagaacaccaaggagatttaatgcaaagaaaactacatcaaggcatttaataatcaaactcccaaaggtcaaggataaagaaaggatcctaaaggcagcaaaaggaaagaaataaataacatacaatggagctccaaaacatctggcagcagacttttcagtggaaaccttacaggctaggagagaatggcatgacatatttaaagtgctgaaggaaaaatcttttatcttataatagtgtatctggcaaaactatcctttaaacatgaaggagaaataaagactttcccagacaaacaaaagctggagaatttcaccaatagcagacctgtcctacaggaaatgctaaaaggagtacttcaatcagaaaaaaaaaaaaaaaaattaatgagcaataaataatcacctgaaggtacaaaactcactggtaatagtaagtacacaggaaaacctagaatattataacagtgtaactgtggtgtgtaaactactcttaccctaagtaaaaagactaaacaatgaacgaatcaaaaataataactgaaataacttttcaaggcatagtgagtacaataagatataaatagacacaataaaaagttaaaatgccaggggataaagttaaggtatagagtttttattagttttctttttgtctctttgtttatgcaattggtgttaagttgttatgaggttaaaatgataatatcaaaccaaaacaacacacagtggagacacaaaaaagaaaaagcaagaaactaaaacgtatcaccagagaaaatcacctctgctagaggaagataggaagaaaagaaagaaggaagagaagacaacaaaacaacgagaaaacaaataacaaaatggaggagtaagtccttacttataaataataacattggccgggagcggtggctcaatgtgtataatcccggcactttggaaggctgaggtgggcgggtcacctgcctgggaggtcaggagttggagacaagcctggcaaacatggtgaaaccctatctctactaaaaatacaaaaattaaccaggcgtggtggtgtgtgcctgtaatcccagccactccaaaggctgaggcaagataattgcttgaacctgacaggcagaggttgcagtgagctgagatcgtgccattgcactccagcctgggtgacaagagtgaaactcagtctcaaaataaatacatacatacatacatacatacatacatacatacatacatataatgaatgtaaagggactaaactctgcaacaaaaagacacagactgggtgaatggatgaaaaaaacaagactcatttatatgttgcctacaagaaacacacttcactataaagatccacatagattgaaaataaagggatggaagaagatattctatgctaatggaaaacaaaaaatggcaggagttgctatacttatatcagaaaaaatagatttcaagacaaaaactataagaagatataaaaaggtcactatataatgataaaggggtcaattcagcaagacgatataagaactttaaatatatatgcacccaacactggagcacccagatatattaagataaagcacatggtattagagccaaagagagagataagcctcaatacaataataactagagacttcagtaccccactttcagaactggacaggtcttcaaatagaaaatcaacaaagaaacatcagacttaatcttcatgatagcccaaaaatcagcagcatttctatatgccaagaattagtagaagaaaataataataaagatcagagcagaaataaataaattgaaatgaaaaaaatacaaaagatcaataaaacaaaaagttggtttcttgaaaagtcaaacaaaatagacaaatctttagccaggctaacaaagaaaaaaagagagaagatccaaataaaaccataaatgaaaaacgaaacattgcaactgatactgcaaaagttcaaaggatcattagtggctactatgagcaactatatgtcaatatattggaaagtctagaagaagtggacaaattcctagatacatacaacctaccattattgaaccaggcaaaaaaatccaaaacccaaacagaccaataacaagtaacaagattaaagccataataaaaaatcttccagtaaagaaaagcccaggacctgatggcttcactgctgaattctaccaaacatttaaagaagaactaataccaaccctactcaaactattccaaaagacagaggaggagggaatacttccaaacttgttctacaaggccagtattactctgataccaaaaccacagacacatcaaaaaaagaaaactacaggccaatatttctgatgaatattgatgcaaaaatcctcaacaaaatactagcaaactgaattcaacattacatcagaaagtgggatttatccctgggatgcaaggatgattcaaaatattcaagtcaatcaatgtgatacatcatatcaacagaatgaaagataaaaatcatatgatgatttcaattgatgctgaaaaagcatttaataaaattcaacatccttcatgataaaaattctcaaaatactggggataaaaggaacacatctcaacatatggcttttattaaaagccataaatgacagacccacaggtagtatcatactacatggggaaaaactgaaagcctttcttctaagatcgggaacatgacaaggatgcctgatgtcaccactgttattcaacatagtactggaagtcctagctagagcaatcagaaaagagaaagaaataaaaggcatccaaattgtaaaggaagaagtcaaattatccttgtctgcagatgatatgatcttatatttggaaaaaccttaagattccacaagaaaccattagaactgatacccaaattcagtagagttgcaggacacaaaatctacatacaaaaatcagtagcatttctaaatgccaacagagaacaatgtgaaataaataaaagaaatttttaaaaattccatttacaatagccacacataaaattaaattcttaggaattacccaaagaagcaaaagatctctataatgaaaactataaaacactaatgaaataaatcaaagagaatgccaaaaaaggaaaaatattccatgttcatggataaaatccaatattgttaaaatgtccatactacacaaagcaatctacagtttcagtgcaatctctatcaaaatgccaatgacattcttctgggaaatagaaaaaagaatcctaaaagttacatggcaccacaaaagacccagaatagccaaagttatcctaagcaaaaggaacaaaactgaaggaatcacattacttgacttcaaattatactacagagctattgtaagcaaaacagcatggtactggcataaaaacagacacacagagcaatgaaacagaacagagagccaagaaacaaatccacacacctacagcaaactcatttttgacaaaagtgccaagaacatacactgggaaaaagagtttcttcagtaagtggtgctgagaagacaggatatcaataggcagaagaatgaaactagacttctatctctcaccatatataaaaatcaaagcaaaatcgatttaaaaattaaatagaaaacctcaaactatgaaattacttcaagaaaacattggggaaactctccaggacactggtctgtctgggtaaaaatttcttgagcaataccccacaagcacaagcaaccaaagcaaaaatggacaaaggggatcatatcaagtcaaaaagcttctgcacagtgaccaagaagcagcttctctgctccttctggaatctctgcctggttcaatccacttgcctctactcctgcctccaccatgtccatcagggtgacccagaagtcctataaggtgtccacctctatgggcagcagcagcttccgggggtggcctgggtggaggctctggtggggccggcggcatgggaggcatcaccgccgttgtggtcaaccagagactgctgagcctccttaacctggaggtggaccccaacatccaggccgtgcaggagcaggagaaggagaaggagcagatcaggaccctcaacaacaagtttgcctccttcataggcaaggtacggttcctggagcagcagaacaacatgctagagaccaagtggagcctcctgcagcagcagaagatggcttggagcaacatgggcaacatgttcaagagctacatcaacaaccctagggggcagccggacactctggtccaggagaagctgaagctagaggcagagcttggcaacatgcaggggctggtggaggactttaagaacaagtacaaggatgagatcaataagtgtacagagatggagaatgaatttatcctcatcaggaaggacatggatgatgcttacgtgaacaaggtagagctgtagtctcagctggaagggctggctgacgagatcaatttcctcaggcagctgtatgaagaggagaccttggagctgcagtcccagatctcggacacatctatggtgctgtccaggacaacagccacttcctggacatggacagcatcattgctgaggtcaaggcgtagtatgaggagatcacccaacctcagccgggctgaggctaagagcatgtaccagatcaagtataaggagctgcagatgcaaagactgagatctccaagatgaactggaacatcagccagccccaggctgagactgagggcctcaaaagccagagggcttccctggaggccaccatcgcagatgtcaagcagcgtggggagctggccattaaggatgccaacaccaagctgtccaagctggaggctgccctgcaacaggccatgcaggacatggcgtggcagctgcatgagtaccagaagctgaagaacatgaagctggccctggacatcgagattgccacctacaggaagctgctggagagtgaggagagccacctggagtctgggatgcagaacatgagtatccatacaaagaccaccagcgcctatgcagatggtctgagcttggcctatgggggtctcacaagccctggcctcagctatggcctgggctccagctttggctctgacatgggctccagctccttcagctgcaccagctccaccagggccatggttgtgaagaagatcaagacctgcgatgggaagctggtatccgagtcctctgatgtccttcctaagtgaacagctgcgacagcccctcccagcctgcccctctggtggctgccccagagcctgggagggaggctgctgtgcagcggagcacagggaatgggagacccacctgaggctcagccctagccctcagcccacccacgggggagtttactgcctggggaccaccttgcccatgccttcagctacaaaacaactcaactgcttttatttttttccccccaaaataaaacctcagctagccctgaaaaaaaggcttctgcacagtaaaaggatacaatcaacaaagtgaagagacaaccaaaataatgggagaacatatttgcaaaccctgccaggggattaataatcagaatatacaaggagctcaaacaatgctataggaaaaaaatatataataatctgatcattttaaataggcaaaagatttgaacagacatttctcaaaagaagacatacaaatggcaaacaggcatatgaaaaggtggtcaacatcactcatcatcagagaaaggcgaatcaaaactacaatgagctattatctcaccccaggtaaaatggcttgtatcccaaaagacaggcaataacaaatgctgtcaaggttgtggagaaaagggaaccctcatatactgttggtgaaaatgtaaattactacaaccactatggagaagattattttttagttttgaggttcctcaaaaactaaaaattaagctactatttgatcctgcaataccactgctgggtatatatccaaaagaaaggaaatcagtgtatacaagatatatctgcactcctatgtttgctaaagctctgtatataatagttaagatttggaagcaacctaagcatccatcaacagatgaataatgcataaggaaaacgtggtacacatgtacaatggagtactattcagccataaaaaagagtgagagccagtcatttgcaacaacctggatagaattggaaactattaaataagccaggcagagaaagacaaacatcacatgttctcacttatttgtggaatctagtaatcaaaacagttgaacccatggacatagagagtaggagaatagttatcagaggttgggaaggtagagggaggatgggagggaaaaaaatagaatgaataagacctactatttgatagcataacagggtgaccacagtcaataataacttaattgtgtattttaaaataacttaaagagtgtaattggattgtttgtaactcaaaggataaatgcttgaggggatggatactccattttccatgttgtgattatttcacattgcatgcctgtatcaaaatatctcatggctgggcacagtggctcatgcctataatgctagtactttaggaggctgaggcaggtggatcacctgaggtcaggagttcaaggccagcctagccaacatagtgaaacccctgtctctactaaaaatacaaaaattagatgggcgtggtggtggatacctgtaatctcagctacttgggaggctgagacaggagaatcgcttgaactcaggaggcagaggttgcagtgagccgagatcgtgccattgcactccagcctgggcaacagagaaaaactcatttcaaaaaaaaaaaaaaaagcaaaacaaatgaaaaaaagcaccttatgtatcctataaatatacacgcatactatgtacccacaaaaataataattaaaaaagataatctagtgaaaagatgattcaggactgatcagaggcaatagttaggcaaaaaaattaaaactgctttgacaaacttttggcagataaaatttgtgattggttgaatgtaggcactcagtgagaagggataaaacagaaaactctagtatggaggactgggtagatgtgacttccccacacgagaaaacagccattgatttaggggcagcaatgaagattttagctggatgtaaagtacccgtgggatgtccaagttgagggagccaggagcaaggtgcctgagctggcacttcagggagaagcctggcatggagctaggaggcaggcaacatatgctcaacgaggaaagagcccagaggtggcatacaggataaacagcaagagaaatatgaagagaactaggaaaatgcagataagtaactgcactatcaataaaatattaaaccacaaatgtgagactcattgccctgtcatgttatctgagaccaatacattcaaaagcaagtataataaaggtacagatgacctgagagcacagaaatgcttagacaaatttggaaaaaaaaacaaacagacattccagatgcaaacctaggattgaacaattagtgtatctttgactatcccccatctcattacccatccagcctgcatcctggcacctagacttgagctctggccctctattaccccctttaggtactgtctcacctgtcccaaatgtgtctttgaatgtccacgtaggttctgaaggtggccttcagtctgtcatgctgaatgagttaaattttccaggaaaatccatatcccaaattattgcttactatgatctcctgcataatgttaagtaacttgggttttactctacatgcttccatactgctacagaataaacactcagcactcgtgaaaaagaatttatggctacagaaaacatatccaagacttacacaagaagatttacagctaagccctgacattaattggctttgtaatccagcttagctcctcttgctccagctgtcatctgcagaatgaagataatggagcagtgaagttgtcacagcatccgaattactatcctgatgggccaggtgtagacagacatccttaagtctgtcactagagagagcaaaacgtcttcatgggggcaatatcattttacagtatttggggcactgaaatattcctttcagagtgtccttactttactacaaaatgtcctaccagggaaagaaaaatattatcaattctattgaaagaaagcattaaaggaatctcactagctctttcagtaaaatcaatcaggaaatcatgaatgataacacttattatgcagacatacattatccatccactcctttaaaaatatttatagaaaatttaggttcctgtggctgtgaaactattctcaaaaaactctgcgtaacctaaaaacaaacaaaaccccctggggctcttccctttgctccccagtaattctcctctgcatttttaatatctgtgtgtcaccccctgtcattaataaagctatcaacagtcagtaaaaggcaacagaagtgtttcattgaaatcttaattgccagacatacagaatatcttaaaaactgtcctttaaatgcccacatttctcaaaatcatctcttaattttatttacaattacatttttcactttctgggtgctccattttccatttttagaatgtcttatatatttgggtagattccaaacagaaaatgagttccaagccttggactgaatcactcattccaatgggtgatcctaaaactgaaatgcaggcttacctcaaaaactaagacctcccagccctcactctgtgcatgcaagcttccaccttttttcatgcaagctccccaaggaggacactgcctctcgtgcacaggcaggcccaggagctgatttggagatctttctggctctctgtcgtctgcagactttcagtgctcccatgcatagatattggtccccttcctgaggatcataacaccttcgagttcttccatcctttgaaacctcctcgttgtgacaacgttccagctagacccagcttgcttctactaagtctgttctgtttactgtctcttttgttataaaattatttactcattttattttagtgatgtgaattaaatgggtcatatatgcttttgctagtaatccaagtgatattgaggtttctacattttaataatgagtcacatcctctggtctaccaatgccacttccatcacccaccccttcctagttaaaaatttggctagcatctttccgtacttttctcttatttgtacaaacgtgaaatacatttacataagttcatttaaagggaatgtataacttattctgaattatgatttatatattctgaattgtgatcatttatgtaacacaaagctcgctgcttgcagagtagaattaacaagcgtgaggcctgttagaaagaaagtgactttattaaccaaaactagtcgtggggaagtggttggattcccatccaaagcaactacttcaaattttggtggggaaggaaagagtttaaaaagggagaacttgatacgaaaggcatgccagaactgtgctgaggacgatgcctgtgcatcttgttccagtggctatcttgggtcccagtccacctggtacatggtctggcatcatctcaacagtggcggggctgctgattagccctctgaggccatctctggaactctgcagctgggtctccaggcttggtctgtctgtctcaagattagcccccaaatcttcaaagaaggcacataattagatgctagcgtacagttagataaataagaagggagtatatctggagaaaaacggagggacgtggagtctattttaaggctaaaggaaacaggcttctgtagtttgcttcaaggttacatcttgaaacccaagagaaagaggaaaaaaaaaagttttaaaatgcattttgaggttatgctgcccagttacatttacatcatgatattcttaagccaaccatctttttaacgtctctttcatagtatggatattccggtttttattctaccatttcattactgatggatcttcacattgaatatttcgtcactagaagcaatactgctacttatttcaacgtgtatcttggacattcctgtagttttatttctgaaggctaaattctcaaaataggatggccgtttcataggaaatgcatatgtacattttgaagagatcataagattgctatcccccaaaatgttgaagtaatttattcctctatcaataagacatatagcccctatttcttcaacagcagtgaatgatactaagttgttttttttttttgctgatttgatagacaaaaagaggtattttgttgttttaatatgaacttgcttgattccagtgaggtcaaatggattggttgttttattttccattatgtacactagttgttctgagtggacttggcaacagtgtagttgagttttcccctttcacattttatagattagggatgttaatcctttgttttatgcttttcaaatattctctcccagtttatggtccatcttttatttctatttgttatttctttcaccatacataacatttcagtttttatgtaatcaaactcatcagtgttcttggtaatggctactaggtctcctctcctccttcagaaggcctcttctatgccatggagaaaatgaggctcgacgtccctcaaattccaggccatgcacctggatctgcatctatcttcatcttctgtcagtcttggagaaagcgatgtcttctggtagaaacagaactacctactgtgttcttcacctcttcattgcttcagacaaaagactgcaaaatgacctctgcatggtcacacccagtaaaccatttttaaccctgacctttattgctcattctacacaggtgacccctctgatgatttcataggctctcacttgtgaattcctgaagacatcctggctgtcctcctctccctccagcaattgtatctcagcttcctgagagcacatgccgcttttcctccgtattttcccttggtcttttttcatttaatgcagtcttacttgttgaccccctagctcccaggacttacagtttagtctctatgctgatacatgcagacttgacctccatgcttgcctctctagcacattcccagatttctcagctccagacccatttttatacagactacacatccacaactgagcctgtcatcaccatcagatatttggtgtctaaaagaatggccagggctacatcccagtcacacaggctataggtctcactgtctccatggactcctcaacactatttgtattataaataaacaccataggatttgtgccctctagacccatgacaccctatattccagaacaagagaacaatcggcctggaggttttgcttggatctcttgtacactcttgcaacagtcccccagcagcaactctccagtcattctccattcagttttgcattctgtagccataaaacctgggtcttgactgtgcctcttcccttggaaaaatcctatcttggttctattggtttataatgaagttcaatctccctgtaaggtttaggagaccacgcatggcttgaatcttacttctttcttcaaccttggttctcactctgcttccttctgcctcctcactctgaccatgtcctctcttcagaaaccatatcctgatttccagtttcctgtctactatgttctctctcacctatgtaccattgaacatgcagttccctctgctgactcagtcttaaagtatgatgggaaggctagagcatcacaaaaatgcctggacagttagacacaattattaataaaagtcaaatctcaaaaggcatgctgtctattaatacaaacactaaatgtaaacaagaaaatttcatattaggaagatgaaatcaacgctgcattaccactaacttgaacaaggggtgggcaatagacacagaaatgaaattacccagtgttgaacattcagattgactttggaatctcacaggctttcctaaaaaaacacttcttccctttaaaaaggtactactggcttggtgcagtggctcacgcctgtaattccagcactttgggaggccaaggtgggtggagtatttgaggtcaggagttcgagaccagcctgaccaacatggtgaaaccctgtctctactaaaaatacaaaaattagctgggcgtggtggcgcatgcctgtagtcccagctactcaggaggctgaggcaggataattacttgaacccagagaggcggaggttgcagtgagacaagatggtgctactgcactccagcatgggtgacagagtgagactccgtcaaaaaaaaaaaaaaaaaaaaaagggactacttattgtacattttgaataaaagacgaattgagagcgaggatttgatgcccctcacggcatcttagtgactaaagatttaccatcagggtgggctcagtttctttcaggtaaatgaaaaatggcaaaaataatgcctttcatttctaaacacgaccataaagataaaacataaaaaatgatgacagatttgacgaactaaatctttaaaatgtctgtatgccaaaacatacacaaaaacacacatatgcaaattaaaagataagtgagtaggtggagaaataatcataaccaaagagagttatatcttcaatctataaaaagctctgataaatatgaaaaagataaatacccccaataaataagcaaagatataaacagataacttaaaaaaagatgatcaataataggaaaaaaatcaatcaaatcacatggaaaagaataagataacagtttgaattctaaaactggcaaaaatgggccaggcacggtggctcgtgcctgtaatcccagcactttgggaggccgaggcacgtggatcacctaaggtcaggagttcgagaccagcctggccgacatggtgaaaccccgtctctactaaaaatacaaaaattattcaggtctgatggcaggcacctgtaatcccagctactcaggaggctgaggcaggagaattgcttgaacccgggaggcggggggtgcagtaagcggagatcacaccatggcactccagcctaggcaacagagcaagactctgtctcaaaataaataaataaaataaaataaaataaaatataattggcaaaaatgggccaggcacagtggctcacctataatcccagcactttgggaagccaagagagaaggattactcgagaccaggggtttgagatcagcctcagtaacatagtgaggatctgtctccactaaaactaaaaaatttagccaggcaagatggtgcatgcctgtagtcccagctacttgagaagctcaggtgagaggatcactggagcccaggaggtcaaggtttcagtgagctgggatcacaccagtgcagtccagcccaggcaatagagtgagactctgtctcaaaaacctataattaatttaaaaaattttgaaaactaaataaatacaattggcaaaaatgattgaaaggaagctaacttcaatattgatgagggtgtgcaaacatatgcactcgcaaccactgatgacgggaacataaaaacccattcaaaggctgatatatggatattctctcaaccagcaattcaactcataggggtttatcaagaggaaatatttggacaaattaaaataatatttagccactaaaaatagtaatccacaaccaaaatattaatggtactgagtgaaaaacatgtacaaaactatgtgatatatacaaacatatatatagtataagcctctgttttaattaaaaatatgaaaattaaatgtattaaatataatgtattaaaaatatgttataaaaggttatgtgtgtgcatatatgcgcatgcctaaaatggcctcagaggactttgcaacaaaagtttaacagtctggggccgggcatgtgaaattaattatcgtttttaaatgtttctagatctcatacatatttaaacaaacagcataaatatttcttataataaaacagcaatactattttaaatgtctgttttgaggacaatgtatttaggaaaattgtatatagaacaggaaaggagtacaagcatggaaaagagggaagtcagtgttaaattataaaacctgatcacacactctatttgttcatcatttagaatatacttttcaaatggtttcaatacaataaagccttaaatgttttgctctaagcattcttgatttgatttttcacacatagtatattttaagggctgttcatttgactgcatttggttcatttaaattcatctcatcaaaatgcaaaatttctaagagctattttatcttcaaaaaaatcccatttaagtctaacttatgtcatattttttcttagaaaaaggaaaacaaattttactaaaagtaaatgaacttaagttccaaaagttcaaggttgacacaaaagtaacttaaacaccataagacagaaaaacatactggccttcaattcttattcaaaaagtttatttacccacatatgtttctttagtcatcagtctacaaaacaatttgaaccaatttttcctatcttttaaaatcttatgttacatattcttctttgacatagcaaatgaatgttgagccttttcctggaaaaagaaatcaaagcctgtcattgccatgtgcccctctcctccaatcctgcgactcccagtccattgaatctatctgtcacttagtttcaagaatatgacattaaacatgctgattcctctacttagaatgacttttcaaatcttttatcttccatgcccagcaaatactcagacccaatactccttcaagacccaatctaatcaccttatctctagagactcctaatcactgtagtggagggtgcctcaacttccttcagtggacaaaatctacatgcaacaagttcatgcacacacacacacacacattcacacacagaaattgacacacccactttcacacacatatccagactcacacagatttacacacaaagttcacacacacagattcacacagattctcatacacactttcacacacatatccagattcacacacagatttacatacacaagttcacacgtgcacagattcacacacacagatacacacatacacacaaattcacacagatttacacaaattcacacacacagatacacacagattcacacacacatacataaacacacaaatttcacacacacaaaatcacacagattgaaacacacacattcacacacatttacaaacatataaaaattcaacacagatttatacacacgttcacacacacaattattgggcttatattgtaactatctgttgacatgtctttcttctctagcagactcagcttcttatggaatgccctgtttgcatgccgacatatacacagaacctccccagatgggtgataccccacaacacattccccacaagagtttgctgaattgattaaacatgacctatcatgaacgttatcattattttagattattttctcagtataatacaactccttttaagatccagtcccatagatgtgaagtgggctgaagagtttggagttcatatgacacaagacactggactttcggtgacaaggaaccatggtatcagatggtgctttgaaagtaacattggctgcacacagtggctcatgcctgcaatcccagcactttgggaggctgaggcaagcagacggcttgagcccaggagtttgagaccagcctgggtaacattgcggaaccctatctctaccaaaaaatacaaagattagccaggtgtggtggtgcatgcctgcagtcccggctacttggaaggctgaggtaggaggatcacatgagcccaggaaggtggagatttctttgaggagtgattgcaccactgcactccagcctgggctacaaagcaagaccctgtctcagaaaaaaaaaaaaaaaagtaaagaaaataacttcaaggagggactgagaattgggagcaatttaggtgtgaccaatctagcatggggtgacagggacctgtattaggaggataacaatggcaaacagagaaaaaaaaaaaaatctgtacgatgccccccagcaagtgtcaggaacaggcaagaaaatattttatgaaattcatctggatgtgagaaggtccatgaactgtgttggacaatacatcaagggaggcaattaggcaaggcccctttcccacagaaaccttgagctacactgtttatatgtggaagcacacaaacagcaaggagctgggcacaggttctcagcaggctgatcaatctgaggctccatcagtgctccctctgctgtagaatcctgagcgcttgctgagtatataacgcctttgccacttcttcagagattcctcccctcgccccaaagtgtaagacagacatcattcagtggcatgtactaaaaatacaatggaatgtctagcatacttgctgaattgagaaaacattaatatcccaggctcctcgggtaccagaatggagtcaatgctagaaaccactcttctgagaaagagtcaaaagtgccacagcaggttcaatgagggtgtcaccactaagttaagatgctgtcacaaggctaataaaaagattaaacgtattaaaaggagaactgatactaagacaaatttgatttcctttccccaaaagaataccaagcatctgagatataggaggttaagtgaaggtcaaaagagacagttagattcattcataagcaatttacttttcaggagagattttgaaagattatttaacttagaatgaatagtaaaatattcaaggtagttatatggcaattaatgaaaaagtggaaatgaatattaaattcctagctcaccagtgtcatggtctaacaagaaaaggaaaccaatttctaattttcccatggaatgacttacataaagaatttgtagatcttcatatacaaagacaaatatttaacttaggccaggtgcggtggctcacgcctgtaatcccggcactttgggagggaaaggcgggcggatcacctgaggtcaggagttcgggaccagcctggccaacatggcaaaatcccgtctctactaaaaatacaaaaattaaccaggcgtagtgacaggcgactgtaatcccagctacttgaggctgaggcaggagaatcacttgaacccaggaggcagagggtgcagtgagccaagatcacgccactgcactccagcctgggcaacaagagtgaaactctgtctcaaaatatatatatacttaacttagattttaagagtttttctcaactaatagagttaggtaaagtaaattacttaactgaactatctgcacattttcccctaatttatctttggaatatagttatgagaaggctggtcaaaaccaagacacaaaggtagaccccaaaaacccaacagggagagggggaatcatgttttccctcacatgacctctctcacaaagggctataaaagccaaaaatttaaacagacttagataaaaatttgaattatttccaaatgcagagtgctaaccactatagtcaagtcatttaaattccctgtggttaagtctcttatctgcaaaacatgaacatataaatctctttgatgacattattaagcatttcacacattacatatccatctgagaagacagcactgaagcagagaagtccaatattatgtatgcaaaggatgccttgcaggaggaaatcctgtcctccttcagttctcactgatttatagatcctaaaatgtataaaaacaagcattaagtatttttaaaatggaaaacaaaatacactggaatgagaatgtttatccatgtgactttgcacatatgaaagctgaataaatgttctgtatcatccagttatttcagtttcaggagttaaggatactgaggataaaatatcctgattatggtgcctgcatttttgtgttcacggagttatcctgtcatatagatagcctaagggtctctgaaagaaaagatggagttacgaatagaaatttatttctaggaccaaattcaagttcaaatttgcatgataatatctgcagtgctttattcctcttaaaacccaagttaccaagctcttaaactcagctctctttgcattttaatgaacagagtccaagtctgatgcttaaatggtttgtttttattttaagcttttgaatcccgcataagacctaccacagtgctaggtactcagtgggtctctaaaaaacttattggctgtttttaaactgtaccttacatgtctctgaattataacacatgatattaaattcagcagcaaggaaaataagcctttaagttcttactttgctatgcttccttgctatatggaaagacagtgtttatgaaaatgtgattgctatggcttacatgtctgtccccttcaaaactcatcttgaaatttggctgccattgtgacagtgataggaggtaggacttttaggaggagatagggcgataatccccaagcggatgggattaataccattataaaagggtaagttgtgtgcctttttatctcttggcccctttgcccctgccatttgaagcctctttgatcccctcgctcaggaggacaggacggcatacaaggtgccaccttggaagaagagaacgaccttaccagacacaaaacctgctggcaccttgaccttagacttcccagcctccagaagagtgggtcaatacatttctgttctttgcacattacctagtctgtgatattctgttatagcagcataaatgcactaagacaatgaccattctatgtggcaaaggctagaaagaggtatagggtttagagttagcttctgaagtgaccagctaggacagaaacactgcgagaaattctttgtgaatcatggctttttcattcctggagtcacttttccttcgataaacaaacaaaactccacctgtgaatataatagtctcatatccaaaagggctggctggtgctgggagaacaggatatatactcctgaagcctttccttaagtggtagaatcattcttcactgatgaatccaacaattattcctgagattgatgtgttgatttagcaatgctctatcactcagcatctctctgtttatgcttttcctctcccagagggcagccattctaaagagttatccctctctgcaagtagcgagactcataaactctacatgagcatatttaaggacttccaccattcaaatgaaaaaaattaccaaatagcaaatgatcctataaagaaaaaattttcaaatgaaaataaaacaaccctcagaaaagccatacaaaaatataacccaccactatcctctgaaacctttggaaatctctgctgtcttactgaagtacttggagttttaaatgcagtttactggctaagactgaaaatagctgggcgcggtggctcacgcctgtaatcccagcactttgggaggctgaggcgagcggatcacaaggtcaggagatcaagaccatcctggctaacacggtgaaaccccctctctactaaaaatacaaaaaattagccgggcgtggtggcagatgcctgtggtcccagctactggggaggctgaggcaggagaatggtgtgaacccaggaggcggagcttgcagtaagctgagattgcgtcactgcactccagcctgggcgacagagtgagactccgtctcaaaaaaaaaaaacaaaaaacaaaaaacaaaaaacaaaaaaaaaaaaaacactgactatatttacatatgcctggacagagaacatagaacactgtacacaaaacattatctgatatacctttaaagttattcttaaccaacatgagggaaaatctgtcattagtcaataaacaaagtcaattgctgagaggaacactctgtacattcagaaaaattagaattcctgccttgcccctaaaaagaatttaaacatagctgctactgattagagacagggtatttcaaagtccagccaggaaaaaataatcagaataattccccttgctcctagatccaggagtcagaaggtgaatcacaagcaaaaaattcattaatttatgcttgtatatcatgattttccagctctctaaattaagggaaaaaagccagccatacaatgaattgtgggcatatcctataaatggattttcagaaatattgtcaaagttcttcaaattaacttttcaagaccaattcaacaaatacctttctgggtttctttcttttctttctcttttcttttcctctcctctcctctcccctcccctcccctcccctcccctcccctcccctcccctgtcccatcccctcccctcccctgtcccatctcctcccctcccctcccctcccctcccctcccctcccctctcctcttctcttttcttttctttttgagatggagtctcactctgtcgcccaggctggagtgcaatggcttggctcactgcaacctccacctcctgggttcaagtgattctcctgcctcagcctcccgagtagctgagattacaggtgcctgccaccgtgccaagctaatttttgtatttttagtagagactgggtttcaccatcttggccaggctggtcttgaactcctgatctcatgatccacccacctcagcctcccaaagtgctggggttacaggcatgagccactgcacctggcctataaatacctttcttggactatattagaaattaactttcatttttatcgtaagtacttttaactctaaaataaaattaatatcaaatcacagtaaacatttaagcatatctaaaaatgagtggttatgggggccatgtcctccgacagcaaactaacttcccttacacaccacatttgtcccgttacccattggctgcatttagttcttctaactgcacccaattcctatattctggaaaattctctggctccattcatttattccatagatatttactccaattatctcaagggtaatgcagggcattagtgtttacaaacattcttcaaacctgtcataattctattcttctcttatttcctgttagcagttatttacatgcgtacatatgaatgattaaaagatataaaaaatgctcagtaaatgttggtaattatttttgattccacatttcagggcaaatatactgagtatttcatagacttacattattattattattattaatttatttatttgatatggagttttgctcttgtcgcccaagctggagtgcaatggtgtgatctcggctcactgcaacctccacctcctgggtcgaagccatctcctgcctcagcctcctgaatagctgggattacaggcgcgtgccaccatgcccggctaattttttttgtgtttttagtagaaacagggtttcaccatgttagccaggctggtcttgaactcctgacctcaagtgatccacccgcctcggcctcccaaagtgatgggattacaggcatgagccaccacgcccagccaatttacattatttaacacatcaacctgattaataacatctccaatattacaaaagcaaaagctgggtttccataggataagtaactacctcagtgtcaccaaggcacccaatagaggagccaggattcacccccatttagcctgaccctatgtgctgggtaataaggggaaagttgtatataagttcagtagacaaaattaaaaggaggtacctttgggaatgtcataataatgcaacgtacctccttctaactacgtgataaagcattataagtatctagatttgataatatcctgatattggcatctccgaagttattgtgtttcaatagttagcattaattcgaaactaaaatgtactctgctaatgctatctgtgagaaaccactaaaatgttctgctatgattgtcagaaatatgtctttatatgttcatggagagggcaaaggtacactatgaacactactgactgagacacattatcaccccattaccatgttctggttggtgagtaagtgtcctgggaatctcagaagagaaagaggtcctgtgccatcctctccaatatgactatgagttaaggtcatagcaatcaggacttgaaatctaccacgaggggctataagccggttcgtaatttgacagctgctgcatattaaatctaatatcaagagccaaacagtatttctaatcaagtaaatggatgactttttcccttgaaacagaaaaagaagttctgtaaacatgtgtttgaaggacacagaaaaagagagagagagacagaataaattaggccaaaagatatatgaactgttaaagcttgcaattaagacacttgttcttgattatttaaagaaatgagttcagttccatcaacactgaccgagtgccttacatgcccgtgataggcactgtggcaggtcctactaatgcagacacaatgcaggcatcagtgctctattagtccaatggtcatgtgaaaggtaagctatatagttaaaatcaccagatccaagtggaagaaggctgtgacttattcacctcgctattttaataaagaactacattttaacaaacatttaattaaaatgtttttataagaacataacataagcacacagtagcatttattcttatttttgcttttttgagatggagtctcactctgttacccacgctggagtacagtggcgcaatctcggctcattcaacctctgcctcctgggttcaggcaattctcctgcctcagcctcccaagtagctgggattacaggcatgcaccaccacattcagctaatttttgtgtttttagtagagacagggtttcactatgttggccaggctggtctcgaactcccaaccccaggtgatctgcccacctaggcctcccaaagcactgggattacaggtgtgagccaccacgcccagcccacagtagcatttattaaaacctggggttacagttgtcactgacataaagactagtctcacttcttgacctggtagcaactatcaaaaataaaacatagagtctcgggaacaaatggtagtccttcccccttacagaacaatggcaataaatatatttatgataatataatagtcataatgaaaataaacattactgtgttgttatgcaaagaataggttaatctgatgattatacatgcataatatgtgattaaatataagcataatagactatcagttaggttgcagtgatttacctttaagaatatcaaaataaacctccttgatgattacaaaatgactttcctcataaagaagcacagaaagaaagtaatcttgactagcaaaatgaaagctttactcatttgaattatcatgcagaataaagggagagaaaaatgtatctatgttgcaaggagattatacatctttcataacttggctctcaataatacaaataactagaaattttcatattttctttgggaaaaaagttacatatcaacataaccatacttgaactaagtgagtttttgagttttttttttttttttagatggagtctcaatctgtcacccaagctagagtgcagtggcactatcttggctcactgcaacctccgcttcctgggttcaagcaattctcctacctcagcctcccaagtatctgggattataggtgcatgccgccatccctaactaatttttgtatttttagtaaagacagggtttcaccatgttggccaggctggtcttgaactcctgacctcaagtgatctgcctgcctcagcctcccagagtgctgggattagaggtgtgcaccgcggcgcccaccggaacaaagtgagttttgctgtgagaaaggccaaatttcagtaagaaataggatgatcagaatgtaatattcctcacattaacaaaaaaaaaaagcaaacaatattaaactaggatttctaaaaaacaactgagtttcccaggaaatgggaacttcataacactgtccagccaggtgggcactatgtccaggcagtgtccctgtgctttgtgcggtcctgctttgctttattagagcagagctcatttttcttttttttggagacggagtctggctcagtcgcccaggctggagtgcagtggcgccatctcggctcactgcaacctccacctcccaggttcacaccattctcttgcctcagcctcccgagtagctgggactacaggcgcccgccaccacgcccgggtaattttttgtatttttagtagagactgggtttcaccgtgttagccaggatggtctcgatctcctgacctcgtgatccacctgcctcagcctcccaaagtgctgggattacaggcgtgagccaccgcgcccggcccagagctcatttttcatcaccattaacgtacagtgccataaagaaagcttctgggtggcacctggcacacggtgggtgcgcagtaagttgcagctgtcattaccgtcactatgagtgtggaccggatgaaagctgaggtcaccatcctctcactctcttccactcccaccagctctcctccccctgcaaagcaccccacctttgggcaccatggctcatcaatcttgtactgttatgctccagctgaaattctgggatttctgacaaactgtatgactgtgatgttttatcttattacaaattttagtgttctttacatagtcccttatgccataaagcaacacaaacacatacccttgagatagttcacatggggtcatacctacgcagattttaaaaataccaccactagacttttttgcctttttctcctttgtttcattgtaaatatcttcaatctctctctctctctcaaaaatacaaaaatgttacaagaaatttaaaaaaaataacactgatagctcctaccatccataaacagatatattcgtattttgctttctttcttcccagtatttttcttcctcattcacacttctgggaaaagaaaggatagtgactgtatgtttaaacagctgtactcataagtacactttttttttgtcttccctttttaaacatttaactttaaatttaacttttaaaatttaatatgtgttttttctgtgtttcagattatttgcaacgcattcaaaacacatcttttcatggtgtaaccgaataataatgaatgtggctctaagccttcccagatactcataacagcaacatttatattaaaagtagagatacacttaggcttattgttgatatttgcatttgtattctcaatactttcgaccattactagaaatctggtcttgcaactctgtttgttttctcactttaaaacctccctggccattataaacatatattcacatattgctttatgtttttgtttctgtcatggtaatactgtacttgacatttgtatctccaacagcatctggcacagtattgtgcacacagtaggcattaagtaagcactttaaaaactgaactcacttaagggatttcaataaaagggctaactcgttggaaattaaataatttgtgaatgagacaccaagtaaatgtattagtcactttctgacttgatataattttcacgtaagatgtgtgtgtgtgcatgtaaacacatgtgagcttatctccaaaagtgccagatgtctttatctttcttctcctttcctttaaaataaaatttatatgtttttaatagcaaagtaataaatgctcattatggaatttttcatatatatggacaaaaaaggacttttcattgttcatgtctaatagtaatatattttaggaataatactaaccttctgagaccataaaatttccattcagattatttttccaaatgaaaagaaagtatctgagagaaaaattttaaatacctgctgataaacatactaaacgaaaagcaaaagtaatgaccttaattccaactttgtatcaaccttaatctatctgcaaagttagccatctttcttttttttattaagatagtgaaccaataaagcagaaaacaagtggctagtacaacatatttcaaagcatccattgatcttgcggctttcttgccactttccatctgaatcttctgtccaccagtcttgaatgggattgcaacctaaatcagtttcactaaagcccacatcacacatagacagctggctctagtcttaatgaagactaatgaaaacaatgaaagccacaatgaaacccgtaagaaacactgacataacctacagactcatcaagctttcatcagtactctggaatacttttttattatgagtgaattggtgaaaaaacaaaacaaaaacaaaacaccgccatgacccggcacagacgcaacgtgtcacttaggagcacatactctgggcacacaacagcctcatgatgatcattctggcaacgtgggaatggctggccccacagactatcctctccaggcctcgtatcaactagcctctcagcttgggagctactctagttcaaagtcaccaggtctgatgatatcatagacacaggtggtcactgtctcatggggggccctcctctgaaggaacaggagccagattcctgaatggcgcactccttcccatcaggctgtgctcaagatgcatcaggctgagattaggctacaagccccagatggttgttaggaaaccattacaaatggctccaaatttaaggatagaggcaagggacagaggtaggcaaacacagctaggaatacacaggcagaatgatactttcttttttttttgtaagtgtcacatcagaactttgtttttctttataggtacatttttgttagtatcatctaaactggccacatgtcgtgttctgctttgctaagtgctgagtatcctcttcttaatttttttaaattaaatttaaaaaatttttcacggatacataatagttgtacatatttatggtgcccatgtgatatgttgttacgtgcattgaatgtgtaatgatgaagtcagggtatttaggacatctatcacatcaagtattcttaaacgatgcaattgtaagattattcttgtgaagaaaaaaatgactaaaaggaacatttaaatggactcatgttcatctcttctgtgtactctgaaaattttaataccaaatatcacctaatatataagcttttttttccacaatcaatacaatgggtgggagggggttcaccttgaggtattgaatacattaagaatttaggttaaacttcagttaagctaactcagcagtaatttaaaatgtttctacaatgaaggataacaattttgacaattatacagcaagtgtgaaataagtaagtaataataatcctttgtaataataataatcctttgtaataataatcaaaattagtgatattctgacccacattcaaattcctatgtactgaactgctagaaaaaaaaaaaaaggcatgttaggaaaaagaagagattccaataatagcagttagtatacagcttcacagtttacaaagagtcttcaaaaccagaacctcatttttttgtttgtttgtttgttttgagatgttgtctcaccctgtctctcaggctagagtgcaatggcaccatcctggctcactgcaacctccacctcccgggttcaagagattctcctgccttggcctcccgaatagctgggattacagacactcatcaccacgcccgggtaattttgtatttgcagtagagacgaggtttcaccatgttagccagctggtctcgaactcctgacctcaagtgatttgcccgccttggcctcccaaagattacaggtgtgagccactgcagctggcccaggacctcattcttgtaacagctctgtggaataggtaggctatttataatccaattagatgtatttatctttgaactcattaaacacaatttatgaatacttgtttcagggatgcattttctggcaacctcttcagattcagctttatgatgaatatctggttacttgtccccatttgggttctgtggggatttgtacagtccagcattgtgccgatcagtattggaactgctcatcatgtacctactgacttatcacctgcctgcttccaaacaccactgcttcagaatctgcaaagagtaaaacagacacaaccaaaagaggtgtgttcactttttgccctgtacattagataaccacagactggatatatggttatttgatggagaaataaaaccaagtaggtaccctagttctcttcaaccttgacacaacagctttatgtagatgtcaacaaaaattttaaaagattcagaaggatcaaaagagtgggacatagaaaaggatcaacattaattttaaaaatatactttattataagaaaaaaataatgtgtggtgtacaagctgtaaaaggatgaaatgtaatgcgatctcagaatgtatgtcaaagatacttccaaagtcagctaacacatcacgattacaaagcccacaggacataacctttaaatcctctgaacaatcacagacatgcaaggcagggaccatttacagaaggacactacgcgaaatgatgacaaccagaccaaggagagacaagtgctgctggatacgatgtcagctaaagcattaactcttctactgtctgaatgtggaaagcaattatatacgaaacagaattaggggttaattaggaagtataagagcacagcccaggaatatagaagtaaagtcagaaagacccagaggcaagtacaatcagcaaagctatcgagggcaattgggcatctttctagaacaactggttgcatatgaaagaaacagaaaaatttaggttcactaatcaatgacaggtgaaataaactgatcatatgcaactggatggcacgtctattttgtgcttttgaaaagaacctgagaagcccttggtggaatgctacatatctggaaaacaatctatcaatatcaataatgaaagccattccatcaaacttataaactttatttatatattcctcatgtgaaactatggcatcatctctctggactttacacagtacggtttatcactgaaatctcacaatacggttccactgggttcagcaaacaaagggcctattttgtttctggaccagatctcttgccttcaagttgcttgctgggggctagatgtatgaagataatgaggctatgaaagggtgtgtaccaggagccagcgggcccagaggaagggcaactggctcaaactcaagggcagtcacacccaaaggagagtcaggatagggcagggacaggaacagcttttagcagagaaaggaaaattttggtagatattaaaaaaggctaatgtcgcttttgttaagtgtgtttctagataatttattctagaataatctaaccattaaaacactcctttgggccaggcacggtggctcacgcctggcctaacactttgggaggccaaggcagtggatcacttgaggtcaggagttcgagcccagcctggccaacatggcaaaagcccgcctctactaaaaatacgaaaaattagcctagcgtggtggcgtgcgcctgtaatcccagctactaaggaggctgaggcaggagaatcacttgaacctaggaggtggaagttgcggtcagcagagattgtaccactgcactccagcctgggcaacagggcaagactctctcaaaaacaaacaaaaaaaaaactacccctttggaagagtagtcttaaacctttttgctcaaattcttcatgaaacaattctgagaaaatcacatgccctttgcatactttaagtacaattaacagtattttatcttacatataaataattacaaaaatgtagtttagatgtaaagactgcaaattctaaataaacattttagaatctcctaaatatatccaatggatctcaattcatgatatgatatccactattattaattttaaaaatacatgaacaagttccttttaaaagtctggacattttacagccttccccttcctcttttctgtttgaagtctacttctattggattttattgtaatatattttgattcttcaaaatctttcattgttcactccatatacatttctgcaacaaaaaaatatgtatgacttgcatggtaactgaattacataggctagtttattagctagaccacttagaggaatttagtatgaatgaaatgaatatgtcatccaagttcactgttagttacagaatgttcacatgctcaaattgttcctatgatgttaattctaaaaagtacagtggtcaaagcctgaaatacttcctgatgtgactgaacatgatattttttggatattatgtagaaatacttcctttgcttttcctgtgctatagttaagctcttcctttcttagagcttattttctctctgaataatctttcagaaaatcacctgagctgggcgcggtggctcacgcctgtaatcccagcactttgggaggctgaggtgagtagatcacgaggtcaggagatcaagaccatcctggctaacacggtgaaaccccatctctactaaaaatacaaaaaattagctgggcactgtggcgggtgcctgtagtcccagctacttgggaggctgaggcaggagaatggcgtgaacctgagaggcagagcttgcagggagctgagatcgtgccactgcactccagcctgggtaacagagcgagattctgtctcaaaaaagaaaatcacctgaaacataactatgatatccctcatggcaacaaaaaattgttcctgagttttctttttttctttttcttttttctttatttttttttgagactgagtttctatcacccaacctggagtgcagtggtgcaatcttggctcactgcaacctccgcctcccgggttcaagcaatcctcctgcctcagcctcccaagtagctgggactacagatatgtgccaccacacccggctagtttttgtatttttagtagagacgggttttctccatgttggccaagctggtcttgaacccttgacctcaggtgatccacctgccgcagcctcccaaagtgctgggattacaggcgtgagccactgcgcctggcttgttcctgatttttcttgaggtttggctctaacaattacagttattgtttttttttaaatatctttagtgttgctctatttgaataattttagtgttatttttaaatagaaataataatttcactgctaatccaaaagtaaataaaaatcacttttccaaagataaaaagtaaaggagttaaggttgaacatgtgttcctctctgaactagagttctaataacacctatattatcaagtctacttacttttaacaggctccatttgagttactaatgctaatgttaatgaataaataaaaagtttacaaatagattcatacttcatagcaaagaaaataagctcattgaatattaatgtcataatcaagttgtacaatgtatacttttaacttaatccaaaatgccttcacaatttctaacaagtttgctgtagaaactcagatacatctggtgaaaaaaaaaaattccaaatttaattgcctaacactgcttgtaataataagactgtaacaagatacaaagatatcaagaagtcaagactgtagacatctcaaagcaggtcaaataacaacatattaaaacccccttttaaaaatatgtggaattctaaataacttataggcataaaaccacttattatctgcccccttcccgtgaaatttttgaaatcataagacaatggtttatcaatttttctttttcttttttgtatttccacaagtgacaactcagcaacttgtaaatgtttcacaattatgcttcaatactttaaaggtaggctgcaaatacgaaatatttctttattattttctcgctaatcatgtccattgagtgaaaggaataattgttaccatgtgatgtttcttacttcatatttactataatttgataagtagatcaatattatatttcaagtatttccattaagtgtgcaacacagatgctcaaaaggtgaaaggcaataacttcctaggcattgaaataaagcaattgtcttctctgtgactcattctttatagaaactaaagcagaaagcatatgatcaatgttcctgtagtgtgaattttctaccataaaagaaaatgcacacattttatattaatggtggaaatcaggtatctgactatcctagaatagctacccaaatctacccttttcatagaacccaataggcatttaatcttaactacagtcatattgagaggcatggttttaaaattaggacagcagagaaagcttagattctcctggcgctaaagggtgaattatttctaccaggggcccagagaaagggactgacttcccaaggaaaggaagcttcatgcatggggaatccgatccccgccacctcctacatacaagagggtcacagaatattggtgcagaaagacactatactagttccgggtttcagacacacgtgaccttcaagaaatgcagggctcctcccaagtctaaatagttatcaaaaatctaactttaggaaatgttagtgaactagttctagtaactaaaaataaacgaaccattaaagcatgctttcttttatgctactacagtatttgtgttaatttaaacttgattttttctcttaacctctatggaaatggacaaaagatacaatgttaccttatatttatatgaaatgtacgaaagttaggcaatgcttccttatttttttagaatatgtggaaaaaaataaacagggctactaggcattttctcctaggccaaacctggcaagtcgtctattttcctattctccaggataatttaacagactttaaacttttctactattttagatgtattttacgaggtggaattaaaaatgaacattgaaaatggcataactgtttcatatccttaaatatttttcccaactcttctttgaaatggttaattatgcacataaagaatagttttgattcacagatttgactctgctgtgattatatatttgaagacctttcttattatgtgtctatattgtatgaattttgcttgtaatacagtaaatacagttttgtctaattgtttcatgcctaatgtttctgacacgctatttatctgttttgaaatgcaccctccaatcttgattcttactcccaacagacatagattgaacttttatcatatacaattttactctgcacaatcttgatcactattcagtaatatgtggcaatgttaaactccataataacaaaccagggcctggtcccccacagggtgacttccactaagtcctttcaggttacaaaggaactgtcattattcctgtgattataggtaaaaataacctgcaatagaattcattcctagataatgactagtattattttacaactgtctcttttcatccagacataattttcatctagaattataatatattgagcattttcaatggtattttacaaaaaacaagtttttatctgaattaaaattaacgagcctttatctgagttaaaatagaatcacgatggaaatgaattcatttcactgtgaattaaccaacatccactgagatcaaaatcaccatctgtgttgccaaaggaagtgtaatatttgtgcatcagcattttcattttaaattttaactttcttataaatttctgagaaattgttttaatcatatcatggaagtctactatttgaagtaacaaatatatgggccccttcaggaaaaaataggctcctatgcaatcgtttttatttcttaatctactgaaagaaaaaatcttgagtttccagatttttattcatttatatactatttcaaccagccattcaacaatatttgatctgagggtctagtacatgccaggcactcacaactgtgaatacagaagtgaaaaacacagaaaaattgctcctcatggagcttacattttagaggagcttttggaagatgaaaaagataataatagcaagtaaataataattagttctataaataacagaaaatatgaagcctaagaagttcatgaaatagaaagaagttgttgcaaggctgggcacggtggctcaagcctgtaaacccagaactttgggaggtcgaggcgggcggataacctgaggccaggagtttgagaccagcctggccaacatggtgaagccctgtctctactaaaaatacaaaaattagctgggtgtggtagtgcatgcctgtaatcccagttactcgggaggctgaggcatgagaattgcttgacccgtggagacggaagttgcagtgagctgacatcacgccactgcactccaacctgggtgaaagagtgagattctgtcaccaaaaaaaaaaaaaaaaagcaattgcagaataattaaatgattaaatattaaatgattaaatgcaggccaaaggactaatcatgtgcccttccctccagacaaattacagtacgttcaagaatgtaggtatcactccttccctttctactcctatactgaaagagctttgcaagtttcacatattattttatgaggtcccagtatacatcctaaaaatgtaaaaatcttttccagtttccatttctggacatatgatcaattaaactgtaatccttcctgctacaaaacaccagaaaagctggctcggtgataagaagcattttcaaatgttgaagtcatttataaaaagaaatccccaggcagttaagaaacaatgagtggacacaaaataagagctaacccagaagataatgacacttcccctaaattggctagtcccggcaaccagtaggcttgaaagctgtgccctcaaaaggctgtggccttgatggtggaccaggaaagtccacccgacctcacaagcaggacaggttgaatttgcgtgtcttttgtccagaatctgggcaagaaaaatgtctttccagataacagaatggggttcaaattgacatactttcaggtccagacatccttaaacagaaaaaataacaacaacaacaacaacaacaaaaagcagtctcaaccaaataatacgcccggcagaggcaaactcgaaagcatgctggagaaagatcctgtcaaggcaggctgcgtgggttattcagtgacagagcccaggtgaagatgggctcacaagtgaaaacgtcagggtacacgacagcacacgtggccattcttcccgaagatgtcaatcagaatatgggcagaactctgtcagcgtaaatatgaagcagaattcacgctcactgttttatgcttgatgcctaatttcaaccatcaacaacaatagtaacaacaaaacagaaatgatgaaaagtcttctagaatatttacaaagcatatacttcactagtttctaaaggtggaaatcctaagagtcctaaaattattaattcagttaataaattcatccttgaagaaaccatgtatccaaataccaggccaggtaacaaccaatttttaaaatctatttttaattgatgtttcatttatgtacagcaaaatgtacaattcctaagtgttcagcctaataatcttttatacatttatatacccatctcatcccaacacagatcaagatgaatgctttcatcaccccaatagcttccttgtgcctctttccagtaacagcgttccctaactctcagcagtaacccctttcctgacttctatcaccaaaacgtggtgtggcctattccttaacttcatgccatcacgtggtatactcgtgttcagttcctttcaaccagcatagggttttgagttcaaccatattattgtacatatcagtagtttattttttaattacagactaataacccatgatttgattgtgccacaaattgtttattctttcttttgttaatggacatatgagatgtttccaatttggggctattatgaataaagaagatgtgaacatttttgtacaagtctttttgtggacatacacacttacatctcttaagtgtatacgtaagagtactaagtcagatcccataccccaaaacgctgttctgatttattttaatcacagatggtgatgtggtttggatccgtgtgatttggatcacccaaatctcatgttgaaatgtaatccccaattttggaagtggggccagatgggaggtgcatagatcatgggggcagtttctaatggtttagcaccatcctctcagtgttgttctcatgacagtgagtgagttatcgtgagatctcattgtttaaaagtgtgtagcccctcccccttctcactcttcctcctgctatggccatttaagatgcacctgcttccccttcgccttccaccataattgtaagtttcctgaggcctcccaagaaagagaagcctctatgcttcctgtacaacttgcagaaccataagccaattaaacttcttttctttataaattacccagtatcagacatttctttatagtagcgtaagaatggataacatagctagtatcttagtacattttctgttgccataacacaataccgcagactgggtaaattataaattacagaagtttattgggatcccagttctagaagctgagaagtccaagaacaaggcaacggcacctggtgagggcctttttgctgcatcataagatggtgaagggcacacatgtcaagagggcaaaagcatgcgcgtcagcttgggcctctcttcttctaaagccgccagtcccatcatagtggccccaccccgatgaccttatctaatcctaattaccctcccaaaggtcccacctacagtcaatatatgaatttggggatttggtttccaaaacatgaacttttgggggacacattcaaaccacggtaaatgggttttgttttagaaattcatatgtataaaagtataaagtatgtaatatttgtttaaggcttctcttactccgcatgatgatttctgaggttcatccattgttgtgtgtataattagttcgttcctctatcttgctgctgatgggcagtcttgcacaagtacttccgtggacatatgttttcgtttcttttaggttagagaggggccatgtttccctttcctcgaaccctcttcccaactttctctcataagacaatgaatttaaaatgttttctgaagtatagctaggatcttatataaaaaacaattgtacttttcatatatgagcagtacatttttatatatgaggagtacatttttatatatgaggagtacatttttatatatgaggagtatatttaaagggtgaatgctcagaaaatattaataagacacccctagattttactatacatattgcatatttatcagattttcagggaagaattgtgattccatcagtgtcatttatgaatttatcgtatctttaacaaactgcaagttttgacaaggcagtgttccaatctatcatgtgttttctcacctgaagactcatttattcaacaaatatttatcaaacatctattttgtgccaaggattgggagtacaggaacacacaaactattcactccgtagttgaagagcagagggtgtggtacagctaatacagcaggcagtcacatacatccccatgtcataaatgctaggacgggtatccccgcatggtgcccagggagcgtgcaggagagagcacctccgcgtagtcccaaagagtcagaaaagaatccagggagaaacaacctctgggagcaccctgggtcctaaaggctttagccagatgaggtggcgttgagagggagagaagagagaagagaaggcaggtaagggttgtgggatggacaaggcagaatgtttcaggcaaacagagtgtcatgaattaaaagctgggaagcaaggggaggcatcaagtcagtaggagtggagagcagcattgaaggtgagggtaatgaggggaggccacagaggtgggtgaagccagaacactgtgtcttgcatgtggttttggagaattaagagtttgttgtgaaggctccaaagagccactgaggagttggggcagcccaaatgtgtgatttggaatcatcattctcactgcagtggggacacagagcggtgtgggacaaagcaggaacaaaaagacacaaagacacattaagagtccattgtaggtatctgggttagagaagttgttggtcctgagctatcatagaagtgggctagaaagtgaaaacccatgtctattcctttacctgtcttctacaacattttcacatgcaaacaaactaaaatgtatttaatcataagaaaatcaggtaagctcttttcaaaattaaaatataagcctcaaagcaccaatgggtctcaaaagcagagagtggccttttagaaagcaatgggggaacaaagttcgcagctaaattggtgttcttggcttggcgatgcagaaagtaagaggctgcaggacggcaaccatactaagtgtgtcacatcctctccgcctggggttcttggctgacattacccatcacaaggaccgcacagggttggtccaactcccaaaccccagaagctccaggatgcattgctattatgccaacttttagttttcacacaaaacaaaggattttttcttttggttcgtggggtgtttcttatgaatgaattgtgtataactcagggaagagttccctatctgagtatattactgttgagtgacagatttctcagttgtgaattattaaggttgcagagatacctctaaaagtggcaggtaacaactaaaaaacaacagtctgcgaattcctacatattttgctactaaatgacatcagctggagccatagtcctcaggccttaactaccaaaaaagttgaggaaatacatactcgctttctcttcagcttttcccctaagccagaggttggcaaactacagcctacaaaccagatgcagcctgctattggtttctgtagagctgtgctggaacccagtcccacccgttcatttacatgttgtctttgactgcctttgcatgagagcatctgacctgagtagatgggacaaagaaccttacggcccccaaagctgaaaatatttaccacgtatcccttaccaaaacacatgcaggtccctgctctaagcgatgctgaaaaataacatctaaagtatcctgttttctaaatttactgaaacgaataacaatgatcaaacattgaaattgcaaaagaaaagttttaaattccccaaagcaacttcccatatcttctttttactgagatgtataaaattcatgagctgcttgagagagtagagcacgctggaaaccacccgcacgtgccatccacagatgggaagggctgtcacatttctgaaagggatcctgcggaagctgattaaactgttagaaaaccatttaagggagatctgccagaccccaccaacagactcagattttagaggacagatatttcagaggagtttcatgaggcatttaaaagaagttcagatccttaacactgcgaggatggataccaagcagaggctcacgaacacttttcagcagagttattaaccaagtcaacacctccctctgttgcctgacttgaatgcagagacaggtgtgtgagttcgacctgaggaccacactgcaccgcagcaattgcacctgtctgaccacagcaacctttcctctcttaacagtaaagcttcatgtactccttgtacatggcaagtacctgctttcataaatcagggcaagaaatggcaaatctatcttaatttccacctcaaaaagaatcactgagcaccgttttaaagggtctcagcactgatccccttgggtattctctgaggcacctgtggtaatccttatttgtttcgcagcctgtgctgaatgaaaaccatccaagtcaaataccttgctttcccctgtagcttcccccactcagtttgccttccagggctaagacagcatgaagcacagaatattgattggaaaagcactgcagactcttcgtaaagccagccaaattatcatctaccatatatgttcccacatgtaataagaaacctgattgattcataaattttagagcatatttctagaaattaacaaaataaaatcttttctgggtccatgtttttcccccacactcatcccctacatatgaagtctctggtgtgtcagctcgtgtgtgacagacaaacaatagccttttccccacaggccctgtttctttctctctcctttttttttttttttttaacttagaccctgccattcattttcacctctgacagtaaaaccccaggacaagattgtcacaaaaaggattatctttcagatcaatggtgaaattgatttgaaaccccactatttatcagcctccagcaaaagtgcaactggttaggaaatatgtcctttcacactcatgttatgctcagttcacccaggcagcacttcacttcatttcacataaatgcaataacctggccttttacttaaaattaagtcattttccacatagatttctatttttttgttagaatatatgcaaaatgaggattcatactccaaaattacttgcatgtatttctaatcataaagtatatatcacttgccaaaagtgatcttttcattatccttttataggtgatagagaatcctttacttctagcttaatataatagaccaggtatagatgattttttcagttaaattttctaaccctgaatatgaaggctaaaatatagactaaatggaaagctccagtaagaatagagaagattaactaactactttcatcctacttctcaatatatttttggtctcccacattgattcccatattaattcccttaccccaaaacccaagagaaaatttattcaaattaccgacaatgttacttgcctaagagttattttaaccacagagtccaatagcagtgaaattttatcaatatcaactaggtaaaataaacccagaaaacccagggtatcaattccttggtataatttaaataaattaatttaaaactaaaattctagtctgtctattcagtaattcaaaacaccctaagaactcaaaatactaaagacaactgtgtaagtgatttttaataggttgatataattcattaagaaaccaattaccacaggtaaaagttaaagaaacagtgtaagagctcttttagcaagaaatgtttacctgtatacttatatagacatatatgtgaagtactagggtaatgatttattatacccaaacagcaaataaacagctaaaaagaaaacaaatatgtcaaaatgatatattcatatcacgtggccttgtacaaacattttacaatgtctagtgtacaaattttaagttccttaagccagaaataaaagtagacaaaaatttgccaatggcttctattttaagtattcatatttaagccaactatttagactaatatgtattttctcataaaatttgactatattcagtgacaaaaattttatgtaaccaaaatgccactgaattcaaatgcagagattcaaagtttattgttaatcttagattccaaggccatacagcaaaacctttcatccaagattagatttgcatttaaaaagatcaatgtgcctacaatgaacagaatgtttgaagaagaagcaaaatagatgtgaacaaacaaattcgtagattaaccactctatcatcttttgcctctcactgaattacagatgctccttaacctatgatagggttacatcccaataaacccaataaacaaatttaaaataccctaagttgaaagtgaatttaatacacataacttacaaaatattatagcttagcacagcctaccttaaacatgcttagagcgcttagattatagcccacagttggtcaaaattatctcacacaaatcctatcttataataaagtattgaatatcttatgtaatttattgaatacgatattgaaagtgaaaaacaggatggctgtatgggtacttgaagtaacgtttgaactgaaagtgtattgctttcacaccattgagaggtcataaacttgttaagtcaaaccattgtaaaagccagggactgtctgtagttcagtcaagaaaagatgattgattggactagggatagtgatggggaagatggagagtcacagatgggaggaaaaactgacaggacttggtgatagatttgatattgacatgaggaagagagaagttgcaaggcagattcccaggtgaacagttgagcagtatagttatttattattttttgagacagtctcactctgtcaccaaggctggggtgcagtggtgcaaccttgcttcactgcaacctctgcctcctgggttcaagtgattctcctgcctcagcctcccaagtagctgggattgcatatgtcatcacggctggctattttttgtatttttagtagagccaggttttcaccatataggccaggctggtctcaaactcctggcctcaagtgattcacctaccctggcctaccaaagtgctgagattataggtgtgagccatggtgcccagcccggttatttattgaaacaaaaacactggaagaagacccagcttgggagtgggtgggtgggagaagagatcctgattttaattttacacgggtggggtttgaggtgccttttgagacatccaaatgtagaagtcacagacacaaagagatctctgggtctagactagagattgattcatgaatcatttggatactgctagttatgaatgccatggacataaatgacattggtgagagaccatctagtgagcttccaaaaaagacaggaaaacacatggccagaaaagtagaagagcttgtgtcaccaaagcctgaagaaggatgatgctggtgctggatgttgctcaggtggcactggtaaacttggtagaagtgaatactgtggagataagaggttagacaacatactaatattaggtggagacaaagcaagtgagaccagaagcacaactttacccattccagaggtgttactgccaaggtgggaagagagtcagggttgtttccaaagagagagagaaattaaatgagtttttttttttaatgggggaaacctgggtctgtttaaaaacacatggaaaacatcccactgataagatgaggctgaatataaaagaaaagggaggataatcaatagagttaactttcttaataaactagaagtgatgggatacaaagcaaagcaccagtgggagatttgccttaggatgcaaggaagcttggatgggtttaggtaggtttatttgcttggtatcaggaagatgagggagtttccatatgttacttttcatttcccatgtaaagtaggagaagagttcatctgccaagactgagcaggagtctggaaaagagaagggaagaggtatgaaactgttgttgtgaagactgggaagaaaagctgatcagagatgcctagcaagagatgggacaagcagtgctgagagctcatttgaagctggtgttcaaacattaacatagagccaatttgtcctcttgggcgtctttctccaacatcttgtggctgcacaggttgaaaggccaaatagttgggttcttccaagttttgtgtttttacagaagacagcaatgcaaagattgaaaagcaaaggtagattctaggcctactctaacacagagcataaacaatggtgttattgaagttatggaccagggagtcaggtggagaaaagaaaaagggaagactgacgtatcgggagaaaatacaggagtcaatagactggaggtcctaatgtagtcccaaaacagtcccagtgacaggggttgaaagcgtaagctggagtatgttcactggaacaggtgaatataccgacaaagtcaggacgttaatgtaggaccctgtggctcaaggacaggaaaggaagcagtgagaagatgggaggtcaaggtgtcggatgctaaatctcccaggataatgggagaggttcgagtatagacagagattacaaacaaggtgtcaactcttctgtgagcaagaaagaatgtggtgatgacacaggagactaaaacttgaatgacataaacctcaaatgatcatgttttgcaaaaggttaaaggacaaatagtcaagaagcagaaattcagagtaaaaatgtcaccaatcccaattcttggccctgggttagttggatgagaatgtaaacattcatgacttgaagggacacttccaggaaatgggaaacctcagatgtgagccaggatccagctaagaataagagaggaagttaagaacatagggaggcatgctggttatggagtggaagtctcagtagaaaaatcatgcaaaacatgtgtgggtggtcagaagagagtacacagccctttaggactgaagggacaggagggtatctactggggcatgggacaggagggtatctactggggcatgggtcagtagcacaggggagaaagtctccacgtttcctgggagtggatgagcaaaggcctcgcctctctgccagtgaggctctcttcctgagaagagacagtgtgctggcagcaagcactggttctgcaccaccatctcagcttcttcacaaagaggaccaacttccagatagaagagaaaaagaagctagaaagaaacataaaggcaacctcatcaaacccctttcatgtacagaagataaagtgcaggcccagggagcttaactgaccttctcagggtcatgcatttaggaaaggggcaggactaacttgagctcaagtcttttggtacccagaccacaaaggtttctgatattccatctcttcctgacctcgccttagactgattcactgcagacctgaagaagtaacccacgaaagtgggaattaaactggacatttgactcaaaaatatttttataaattagaaattaaacagaaaagaatagcaacttcatatagtttataatcagaagaggagtttgtggcttttaaaaggtaaaaagagtttattttacttacgatgctaaatttactcctatagttatgattcttcattgtcctgaaagtcaaatatcactaacactgatatcaaattgactgtgcattggcctcaaactgcctttttaggtaatctctcattattgtaggatcaaaatcaacattttagccaagcttcaacacaaactttggatatttaaattcttatttttaaatttacattattctttatgaaaattgactactatatttaaaacacataaaatacattaaacaaaataaaactaatgctctacaatgattttattgccacagaaatcttatttatctttgtgtaatctatttcactaggttagtaccagtgattctggcaataccctaagacagaataaatggtaggcagctgtgacatatcacaactaagcgttcttaaacgcataacacagacattaagtaaaaaacaacattagggcgattatacattaattacatggatacgttttggaacaaaagtaatttaaattgcattttccatagtgatactttgaaaattcttaccatttcatgtatgttttgaaatcatttgagatggatgaaatgtaagagaaagaacgctcttacaacaacaacaaagctcatatttacatagcatgtactctgtcaggtactgttataaatgctctgcaaatatgaactcaacccttcttcacaacaaccctgtgtgctaagcactgttgtccccatttagtgacgacaaaactgagacccagagagggtatgtaaatcatccaaggtcacacagttggttagtggtagaggcaggatcagacctcaggaggactgcctccaaaatctaggctcttcaccacatgctatggttctgtcctaagcaggattttatttgtaaaaatagctctagaaatcttactcgctaataagtttataacgaatgtgctgctacgctgttagaggtcactattccaacatggaagcaaccatgtcctgctacgattcctcaccaggctcacatattgtataatattaacaagtaacgttaaactataaaaccatttatacacaaatgaaggatttcttgtggtataatagtaaccatagcaacaaagtaagatgggtttgcaaagtgaaaagtatcctaaggcatttgatgccctcacaaaaagctttctctcaatttacaagaagatgtaaccagtaacagcaaaataatagtaaattttcaaaacagattatattgctatctagattagcaatatttcatgttagcatttttatttctaaaagaacaaggggctatattcaaattgctcccatttacatctctatagcaggaatccttaattcattcgagattttatgataaattttgactaaggtaacattttttaaaaatcatgatatgtacataggttcaatgacaaaaatatgcaattagaataaagttgtaacaatatcacatgcatcctacataagtataatgagtagaaatatatacttagcatacaggagaatcataattatctttagatttatttccctaagaaatagattttattttttgtatatcagaactgattgtgaagaataggcctcactggagaaataatgtgttgaatccttttgtaatatctattggcaaaggaactatacaattgcttaagtaaataaatattaaagactgctagtaccatatatagaattaataaagaaagaaatattaagggagggctctgcttttgctacaggggtttctcgagccttgttctcttcaatgtatatcaatgaatggataaattaaagtagcttattgcttttcaaatatttggatgatagaataagaatacaaaattcagattgctacaatgtgctgatcttattaagctgaagtttaatagaagtaactgtgctagagtttcgaaaaacaacatacaactagcagaactaaggagatttggtattaactgacaacagcttccatacaaatcaacagcttataaccattcacagagtaaatattatcacaggtgtatcaagggtgcattacactcagaaggaaggagccgctaacctaccctacactatcacatcacacctccagtacaagggcattgtatttcaagaaggacacacacactgagggacatttacaagaaaagtgccaggatgatggtggattgttaaaataatttcatgtgaggtgtgtgtcacactgagaaaggtccagttccacttgagaagtttcctgaggtcagggactgaccacatcttagttttgtcatcaataccaagtatgcagtagactcaaggtaaatgtttgttgtacaagtgaagcgattaataaatctaaatgtgcagaaaaagatacttagttatgacaagagtgtgaaaatcttcaaatacttgaaggagtgtatataaagaaatgatacagcggggcgtggtggctcacgcctgtaatcccagcactttgggaggccaaggcgggcgtatcataaggtcaggagatcgagaccatcctggctaacacggtgaaaccccgtctctactaaaaatacgaaaaaaaaaaaaattagctgggcgtggtggcgggcgcctgtagtcccagctactcgggaggctgaggcaggagaatggcgtgaacccgggaggcggagcttgcagtgagctgagatcgcgccactgcactccagcctcggagacagagtgagactccatctcaaaaaaaaaaaaaaaaaaaaaagaaatgatacaaattatttataataatagaacttaaacagaacctccataatagaaccaggaccaaagtgtggaagccacgggaaaacaaatttcaattcaaaagaccatctagtcagggctgtcctaggatggaatgttgaggttcctcatcttggaagggatcaggccggacgaaggtttagacatgttaacactggggaaaatagctttctagcgcagtggaaaccaggggcagagacatcgcggtattgaaccagatttctctcgacaagttaagatgctgacttgctgaggctctgtttggtcctagggaccagatgcagtgagccgagatcgcgccattgcactccagcctgagcaacaagagtgaaactccatctcaaaaaaaaaaaaaaaaaaaaacagcaaaaaacaaaaccaaaccaaaacgttgccttaaactgaagcatacacatcaacagcataagttcttccaggatgatgatgaaaggacaaggcataaaatggttacagtgtccccagagttacgctttccagacgcagccctaagtggtgaaaaatcgtgctcctggagctccctagggagggtgcagcttccaggagagaggctgcacctgcttctggcccacagagggcaccttgctgctcacacatttttatactactggatcattcaattgtaggtttgcaactagtctcttcccaccaacctataaccccttggaagtaaaatgtttaaaatttccactaaccctgaaattttgttactatcaaatattggtttaaaagactaaaattaataccaacaagacataccaattaatcctgacatgttgcctatgagggagatactatcattattatttccactttacagattaataaaatgcaatttagaaatataaaataacttccccatggtctctcagtttgtagcatttggactaaagctgcaggatatccaactccaaaactcaaggttcagccatgatgataagatattccttgcacttagaagcactgacattaaattaagagagagaatgaataacagcagctttaaccaaccaaccaaagtaaacctgttttttagggaatagagaataagtcttgattttttaatttaagggaatttgtgtaatacccaatgagataaatttcaatcctgtattacaatcagtttgactcatattatcttgttgacaaaccatagatttgtaataattctagaaaaatgcctctgttgtgtttcaaactcactacgtcactttacaggcagccacaggtgcagttgtttaacggtgagctgcctgtagagtataaccaagacagctgaactctcattgcagtttactgtaagcttgaagataaataactcattttgcagcaaatgcttctacctcttcaccaacaattacaatcctttagtttttcaatgtacataaagagaactcccctaagaaaaaaatgaaaaaatatacacaaattttgaaagtcatccttcctgagtaggtatccattgtaaacagaatggctgataaaatgccttacagactgaaacgcaagatgaccaagcatgaagatttaagaaataggagtaacaaaaataaaaacaccatataactaatacagtcattatctcagaaataaatgtgtattgcttagcttgaagagtcactaccaaaaaggtcaagatcttaaaagaacaggtactgttgcaatcactgagagggttccaggaaatatacagctaatatgaagaaacaaaaagaagagaaaagtcctgaggttagcaggactagtggaataaatgacaattatttaagaattctgattatgtattctgtaaattatttcttgcatttataaatactgtatttgtaggagtcaaatgattctgacaatattacttttgtcttctcctatagtaatattttaatcataaactaacacctcctaaacatgtaagagatatctgaactttttaattaattaaatcacccagttagttactaggtgagttacctgagtgcctctagggactcaggagatggcggtggcaatggcataaatgagaagggtaagtcatgagggggaagttttgtgccataaacctgtaagtgcaaaatcaggcaaagggccacattgtctgctttacatgccattttagtgtctctctaaaaaatattttcattgcccttgtaaaataatttatatatgttaacttatacatacacttcaatatatttgtgcatcaaatttcaaaagctctagaaccctgaatatatttaatgtgtgcctttaaatttgcattacacctcaaatatataaatgtcaaatatgtacatgaatttttaaaacataaaaatatttttaaggatgccctgtggtctaaatcaaataaatgttcacgaagggaaaggaaggttaggcactagactctactaggccacaacacgtatctgagctttgcctatgaagttttgaatctacaaaaacaacttatctattttccagatttgtgaactctaattgatgaaaactcaagtctgtatttttttaaaaaagaaactgaaagataactagcatagaaagagccatatacacagtttagttggttttgctactgtttatattttgaaaagcaaagattataggcaatgctccacactgtaaataacaattactctatgtctaatccatttctatgcattgagaatagaacacacagtcaagatgtgtccatggtggctttttgctttattctcaccaattaacaggtgattggatatgacagtaattagacacctcagctggaagaagatcattatgtcttaatgagaggattaaaaacaataaaaatgtgcttattgcaaaatatgagcacataccttaagtagcaatagtacaatttattttgtctccaagtttattgtgctttgtcagcccatatcaaaaaaaatttcccaccaacatgtgacttagaaaattacgcaacctaagcatacaattaacaatttttggtgagtcagttctatgttttggcttattttttttgataatgttcactagtgcttctctgacaagttacagttgccacataatattataaatgttatactggtacatttcacattcacccaaaatttcagctatatactcagcagtatacctgctatgtagttcaagataccatctcaaatttaacttcctcaatttccatgagatggattttttttttagacctgcacacagacctatgtacacccttggcaggcactcacagatgcagagtgactggaaggagcacagaaggtctctgatgcaatgcacatgccaccccagcaaggtcaaaagtctcctagcaactcttcttcgggttagagttttgtttccctaaaactgatgtttaattgcatgtgccatctgtaaaggacagtattaatagctaacacctcctcttattccaccattaattaattatcaaatgtgccagcattgagatctgctttacaggaactgaaaaatacagtgtaaaatcaggacaggatagaagagagggacgaagaacgacttgcaaaaccctacttgtcaggggacatgtgggtaaaaagttttgttcattcactcacacactctttcagtcactcattcagaaggacttactgatcacctgttatccacattggcagagtatataaattaatatttaaccaaggtaatcattctttagtcctaaaccaagaagatgctctcataaacattatgtattattgccaatttggaagtaaaacaattctatacccgtatattcaaaaccatgagctgtcacccaggaacctcctaactcatggctcttaaacctataaatattagggtatccaaatgtatccttctctccttcatttaagagacagaatagggtttccctcttttatttaaggcccatttacccatatcctctggacactacccctgaccccactgccttctgaagactttgtgcattatcccatagtagttcatggtagagtatttatttgcttgatagtaagcccgctggggacaagggagcttgcctactttattcttatttctatctctagcatctaacacaccttggcacacaatattaagtcaatcaatccttgctgaataaatagacttagcaatgtgcacaacttctgccccaccccgttgctatcactgtaattaccccattaaatgccataaatattatttataaaaagaataaaacttacactgccttccagtggtaagcatataattgttgcatgacactctatacaatgatacccccccgtaatataactcactacacagtttttacactgaaactgtatccttcttgtattataaaggtgaaatggtatatagccaagcatatctgagcaatggtatggctttttcttgctatcttctatcaatcaatttatttgtacagcacaaaattgctactcctctgaattgaagcaggagaaagccttacataatataacactattctgatacatcttgacatatacattatgtaacagtacttttcctttgctatacttcgcaatataatcgagaaatgctcttttaaagtcagcaacatcagcaggaataagacttttaaatgaagctcctaggaagacagaattctcacacttaaaaacaaagtatttattccacaggaataaatattacatgttttctgaaattgatcaactgcagtgatcaggtaacacttgcattgttaagcagtaagaatgatttcttaaaaattattatttaatgtcatggcattttaagttagatcttaaaatttttaattgataataattgtacataattatgggtacaatgtgatattttgatatatgtatacattgtagaaagattaaatcaagctaattagcatatgcatcacctcaccctacttaccattttttgttgtgagaatatttaaaatctattcttttagcagtttagaaatatataatacattatgattaatattattttttgagacggagtcacactctgtcacccagcctgaagtgcagtggtgtgatctgggctcactgcaacaaacacttcccaggttcaagctattctcccacctcagccgcccaagtagctgggattacaggcacctgccagcacacctggctaatttttgtatttttggtagagacagggtttcaccatgttggccaggctggtcttgaactcccgacctcaagtgatctgcctgctttggcctcccacagtgctgggattacaggcatgagtcaccatgcctggccatataatacattattaactatgatcagcatcccatgcaattattccttctgtctagctagctagaactttgtaccctttgaccaacatctccctatttccttccactccagcctctgcttctatgatttcagcatttttagattccacatacaagtgaaattatgcagttatctgtctttctgtgcctgacttatttcacttagtataatttttatctgaaaaataatttttttttgttatggtcctatgatgaaatataaaaccatagtaataactaacaagtaatagtactaccaggagtactaatactacttaaagtttattgagcacttactatattcaggcactttcctaaggggtttcaatgtattagtgcatttaaaactcagagcagccccagtaacacaagaataatcattatcagtatttattcttccctaggaacctgaggtgcagagatttgaaggaattttcccaggacggcagctgataagtggtagactgagggtttaaacccatgctgttagtgttaaacattattctttctttagtgtctttatactttcatgtgaataaaaataaattactattacatgcctctttctgtctgaaactgaagtcattttttaaaactgtttggagcacatttcagaataggaatgatattcaggatcagccactcaaatttcaatattttaaggaaagggtcttatgaagtgtgtattcaatcttatcaatgcatggataatggtgagctatctggcaactgccaaaatcctactactgtatgacttagaaataaacaactattttaagcgctacttggtaactatgctgccaaccagtttctacactgcctttataggaaataatgtactgtgatcaccaatgactctgtttataataaatcaaatattttataaatttatacaattatatggaaatcccagacacatttctcctttagaaaggcaagcagaaacaaatctatcccgtgttcaggaaagtaaaggttttcttcgtgagtacgctctgaatctaaataagcctcagtccaaaaagagttttactgcagactgataatcccctaggtttataataaaaatgctgacagagctttagctacagcataacaaatgaaaggccataatgttcttctgtcagaaattcctatttatttccagtgtcctaacagatgggctttactgccttgaaactcccccccaaaagttaattgcttgtctatcaaaaagataaacatcttgttttaggctttggggatattacatgtgtagagaaaaaccaatactcgagcaacacattgtgtccgaaatgcattcgcagtaagagagccatactctctcagggcatcagagtaaggaacagctggatgactccaacttcttaaaaagtacaggattctctgcatagtgacactagcatctataatacctagattttagtataccaataaggattgatttactgccacataaatgactataataactttacaaaacaaacttcaaaatgaaggtgaaactcttttagactcttgaaatagtgcctcaagcaaaatgaaccttaaacatatctaatccagtatttttcctttttttttttttttttgagatggagtctctctctgtcgccaggctggagtgcagtggtgagatctctgctcactgcaacctctgcctcccaggttcaagcgattctcctgcctcggcctcccgagtagctgggactacaggcatgcaccaccacacccggctaatttttaatttttttttttagtagagatggggtttcaccatgttggctaggacggtctccatctcttgacctcgcaatccgcccgcctcggcctcccaaagtgctggaaaactatgcgtttactactttagctagtgtacaatagcatggggatctcattctccaaagagctggtttaaatggaaaatatgtagacagcctcttaactaatgattcgcattaaaaaggaaaattatgactttaacacatgcgtattggtgccactaccagattgcacgggaaatgaacctgactgaatctggacatttttgtgttcttagaatattttacttacaaatataacagttgtataaaaagtaataatacagaagtgttggtatctatcctttcactttttccactcacacacacacacacacacacactaccgcagataggcaagcaggccgactgaagcatgttgaataaatcatacttctattcttactgttctgctgcttttttcactaagcaatgtatgatggacatctttgataaaggcctcattcattctgacgaatggacagtttccattttatacatattctacaatgcactttattagttaatgagggtatcttctctctcacaatattttttataaacagaaaggtaatatttgcacatgcattaacatacatgacattgcaatctgatatgcttaaatacatattagacataccaaaatatatcaaatacatattatttcttaactgctttgcacgtgcattctgcttgtcttctatggaagataaagaattgagggatgttatacccattccctccttctttcctattctacctcctgacttctggcatttgtattttacttttatctcctcaacaggttatcatttataacttcaagtaatatatatttaagctgtcttgttgacttatcaaccttaagtcaacatctttttcagtgaaaatgaggaactgctgcgtagacacttgattccactttttccgtgttctgccaccttctggttattgttaattacattattttttttctaacatcaagagaataatttagtctccaatgctttgtgtaaaatttgattctaaaaattaaaactcaacataagcaacatttctagcattatgactactgaatactattcattgcaaaatgtagtagtgtaattagatccttagggaagggattttcatccaacactaatgtgctgctgcataagaaagagttttgaaagtttcaggccttcatgtattatctttttattcccttttagttctccatttagtttcagttttccctttaatttatattcagctatcacttctcctgtatatcatccttttactcattttttttgggttaacacccaacacatttgcatatagatattctttttaatttttaataaagatggggtctttctatgttgttcaggctggcctccaactcctggcattaagcaatcctcctgccttagccttccaaagtgttgggatgacaggcatgagccactgtgcccagatatatattttttaccaatctttgtatttccggtgtgtatgattaaaagttgggaatagaattctatatttaaattaattttctctcaggtctttgaagacactgctttgatagcttctcggatccagtgttgttgatggaaaacataatgttagcctggttttcattcctttgcagacaatctattttagtctcattggaagcttgtggcatcttctttattttgaaatttcatcaagatatctccacatatccagctttgatccagcccgcttgccagacttttacatctgtctattgatgcctatggtaaattgagagcagcaatggccccaatttgtgcctagctttggaagagcccttcccgggttctctgggtttggccacataatttgctttggcccatgggacagtactaaaggaaagtaagtagcgacttgaaaatgcccctgccttggaaattgcactcctgctgctcttaggaatcctgctgccaagagaacaagtcgaggttagcagggtgatgaaagacacatggctcagctcctcccatcaccacaaagatcacagataacggcatgtgagttcaccttctatgagctaatcccagccaatcttccactgaccagagaaacatgagtcagttcaggtggaaacagccacactgcccacatcagaagaatcaaccagccgaatcagacacaagctaaatgaatggtctttgttttaaatcactaagttttgaagtcatgtgttacataacaaatgttaattgacatagactatttcttgagcttataaaatgttgtcatgaaactttattttctgcctttcattgtcttattattttgtattaatcagatgttggacctactgactctattcactattgcccctaactctttaatgttccatttccttatctttctgttttaagtgttcagagttaatcttcaatttatttatttattttttatttactgagacagagtcttgctctgtggcccaggctggagggcagtggcaccatctcggcttactgcagcctccatctccgggttcaattgattctcctgtctcagccttccaaggagctgggactacaggtatatgccaccacgcctagctaattgtattttttagtagagacggggcttcaccatgttggccaggcttgtcttgaactcctaacctcaagtgattcgccctcctcagcctcacaaagtgctgggattacaggcttgagccaccgcacccagcctaatcttcactttaagttgaagaaaaaaacatgtttaggcatcaacagttccctttccattatttggtttaatacatttttactgtgataatcatacttttaatttcctggaaatttcttgttttgattgttcctttttcataacagcctttacagctattatttcctttcaaattctgtttttttttttgttttgtttttttttggtagcagagtctcgctctgctccccaggcgaatttttgcatttttagtagagacggggttttgcaatgttggccaggttggtctccaacacctcgcctcaggtcatctgcccaccttggcctttcaaagtgctaggattataggggtgagccaccgtgcctggccttcctctcaaattctgctgagggtattaattagacacctttttaaaagtttctggtaatccctgaattgtacatgaatcttctggtatcggttgcccttttcattcttctaaatacagtttttccctaaatatctgattgatgattcttggatctgataatcctagttacttttctaagtgaaaaatgacattgatttgtatgggtaattcatattgtttcatctgcactgtgaaatacatgatcccaaaaggcttcttcctggaatgaaagacatgtcaacactcagaacattctgtgggtttcatgagcggaaaagcaggcaggcaggctggtgacacccatgcctgccaagacagacaagttttattttacacgtgaaatgctttatgaacctcccttttttacacgtgaaatgctttatgaaccgccctcctgaacacctttcccacttttccccaatgctcaatgtaggatttcacttcagagaaacaaaacaaaacagaaaacaaaaacaaacaaaaaaaaccttttccattgttttaatgctaccatatgagaaaagagaattaagctagtgtgttgaacctgctgacttaaactggaaacccagtcattaggcttcagcctcaacctcttttttttggatcttgttcgttagcttcttcgggtcataaatgcctcatgctgataacagaattcactcggttttatttttgagagaatacattttgagaatgattcatgtagggaataatttatgtgtgaagaataaagtttccaatatagagatcttattttaaaaattggctttttttcttaatttcagagaattgatgacactttttaaaggatttctgaaatcagtgatcacttagatgaatgttgctattatctgcacacattgctacattaaacgctccagaatttaaagttcgtttgagctttctgacactaaataatatttcgttttatttccaaacttatgaaagcaacataggcccaaaaggacagcagtatattaaaataaaataaggttattttccaatgagaatagagataaatcattttcccaaggagagttcaccaaagctagagactggccgaagaaaagtagccctcagcttcaaagatcaagctaattttaaaacacaacctatctcctgcttcatttgtcttaaatcttaaggctgttgtccaacaggtcatggcagtcaaaagaactgtcatataaaatgtacatctagtaaggccctctctatttttattttaaaacagtgattttaaaaattttggtagaataacctaattatcaaataaaagcttatagaaacccacatacctacacatatataaaaaaactgaagtacagttgttttgcttgagaaggctgaaggtgggggcagagatgcttcacagcctagcttcattcagggtcctgagataccacaaagacaccgtttttctcaaacaaaactgaaatctgccaggcatggtgtctcacacctgtaatcccagcactttgggaggccgaggtgggcggatcacctgaggtcgggaggtcgagatcagcctggctaacatggtgaaaccctgtctctactaaatatacaaaattaactgggcatggtgccgcatccctgtagtcccagctactcgggaggctgaggcaggagaatcgcttgaacccaggaggcggaggttgcagtgagctgggatcatgccactgcactccagcctgggcaacagagtgagactctgtctccacaaaaaaaaaaaaacaaaaaccaaaaactgaaatctactcttctgttacgtgaggagaacaatctgtgtctcatatttaaaatttacaagtatagatacatttttcatgaatatttattaaaaacaattaaataaaaattattccattaactcatttgtttaacatttccatgtaaccacagcaatgcaaagcactttgagagctgcatgggaggtctaagacatggtttctaatatcggagttcaaatagaaatcacatcggaagctgaagccacattgtgtggtgctcacttccacagcagacttgtacagcttgaagtatttaagcagattaactgtaaaggaaaaggaaaaatgttacttagctgcatcttaaaagactcttgggattcaaacaatctataggaggaagacagctaacacaccagcggtagagaaaacacaaacatttttgtttgttcggttttttgtagagacagggtctcctcttgaactcctggcctcaagggctcctcctgccttagcctcccaaagtgctgggattacaggtgtgagacaccatgcccagcaaggacagattttcaagaagagaacacagcagggatgtggtaacaagaggacatctgtgtaactgaagtggaaaataacatatattggagcttgaagggaaataaaattaaatacctaagtgaggaaaatacaattagtgtttcaaccatctgctaccacttcctactatgcccttccttctgggaaggctctatttcccttcttcactcaggtaaggctcttgcataagtgacttgctttggccaatgaaatggaattagatgaaatcactgtgatgtctcttctctctgtcataaggctgaacgtgctccagatagaaccagctccatcagcttctgtcgtggagtgagggcaacttcagccgtgccactgcaaactcacgatgagcgtgtaactgagcgaggaataaatcagtgttgttgaagcccctggatcaattatcactgcagctcagacaatcctcactgatacaatgcttagtaccagatgaaggatgacgttaaagtgaggactgatgtctatctagtgtaggtttataaacagttttcatttccaaacatgccttttcactcagtgactttaacatggggatgggtgatgctgaacttggtcttgtctagccttagtttacatggcggcatggcagccagtgctcatgttcaggaacctaagatgagaaggcaagtgtcttcagggtttactcaatgtcactttctcattaagacttaaccatccatttcaaattgtaaatgagtcccttcctctttttttctactctgtatctccctcccttattgtctttctccacactacttcaccaccatttgcatgtgtgtgtgtatatgtatttatgtatgtgtgtgtatcatgtatatatatgtgtgtgtgtgtgtatatatatataaacttatgtttgcaaaaacatatctaaaacttatataaaatttatctagttgcaaaaacctgaaaattaatacacatctcatagttcctttctgaaaaattatgatctctacatccccatgaagaaagtaagacaaataaacaaagcactaggaaagttactccagttacttcattagcatgaatttgcaagaaagacttcagtctgctttctttaacagataaaatatatcacagttcaggcagaccttgacttacgctaactcgacatatcttgactaatgaatgacttatttacaactgggtagagactaggaaaatccccacatatgctgccaaatacaataggtatcgctggcaaccaaatcagaaccattcccctgcctcacaaaatgatacttaggttaagtgcaatcattgattagtgcaatatttctggtagatttggggttaatctggtttttgcatgctggatggggaatttaccactgttatgttctttcatgacaaaacaaatgtgatgttttaaacaaaaacattttctaatgcatttgtgtaatgtttccatttgaaaggtagagaatgactgtgctatatttgcaaaacacaagacctctcagggacagcataatacttgcacttccaaaaagcttttcccctcaaaggaagacactgtgcccttgagaatgactctcgaattaatcatagaggaagaactttcatttataaattactactcttacatttcacagatgaaagaaacagaatactttataatatttaaaaaaactatctggatatggtggctcaggccgggtatggtggctcaggcctgtaatctagcactttggaaagccgcggagggtggatcacttgaggtcaggagttcaaaatcagcctggccaacgtggtgaagccctctctactaaaaatacaaaaaaatagctgggcctggtagtgggcgcctgtaatcccagctactttggaggctgaggcaggagaattgcttgaaagcgggaggtggaggttgcagtgagccaagatcatgccactgcactccagcctggacaacacagcgagactctgtctccaaaaaaaaaaaaaaaatttaactgagcataagatgattaaaatatagtcccttcacatgtctttaactgcattatattcaataaaatattcattttaaaatgaaaacttgaaagtaactgaccattcaaattttgaacaagctgaagaagcttcaaatagcagataattaccaatgttttaaacgtagtatgtcctggagggaatccaacatcaggataaacaaggcaaagtctctgttctacagaattcaatgcagtgctggagactgagatgcaaccacataatcctatcatctcaaactgaacttcaaggagggagtaactaactatgccctgaaaatgatggacaatttctaagagggcttgatacttgggctctgtcttgaaggatgcaaggtccttccttatgaagaatctaccatacataatagtgcagaggtgaaaagaaagcacattcaggaaacagtctgtgatggcttcacccagaatagagggcattcaatgacctggaagatgttttaagaggttattcaaaaatatttactatcaactcaatgtttgtcataggaaatgattttgtatagaaattatttccccagattgtgaagagctctacgctgcctactttggagtttattttataggtaatgaggagttatcagtggcttgtaaacaggagactggtaggatcaatttctttttctttatttaaggaaggtaactggagttggaggcgagggagactggtgaccaagagattagttaataagcaactataatgactgaggtgagagatgatgaagggtaaaatggggcagttaggcagggtgaacgcaggtgaagaaattatcaccatacacaatggtgtggcgaaacaaataggtggagagacacaagaatctgcaataacttttaagaatttataacttaaggaactgtttgggcatattaaccaataacaatggagcaactagagatgatcagtgggcagttttgaatactaggagagatgtcaagagtcatcacaggacaggttgtagttgaggccaggtcaagagtctaagatgccactgtataggatatagcagtaaaagaaagaacaggaaaacaagagacctaagcagaggaaagggagacatcaaaccactcggtatcactcgagtgatagagccaatgaacatgggctacagggagtaggacacaatgtcatgaggtcgacagaagaaaatacataaggactataacagtctttagaggtagcaataaggaagtcattggaggaaaatttgagagtttgtggggttagaagccagactgtcatgaaatcaggaatgggaaataaggcagagaaaaaaggtcgtttctgaaagttttgatgatgaagacgcagaggaaacaaggacagttggttgagggtaaggtagagttgaaaattaaggtaaagggaacttaaacataactgtatgacctaaagatggatccagttaagaaatcaatgatagaagctataattgtgaggcaaagtaagacagaaataacctcggagatgaagaaaggaggccacccttttttgagcattcaatgtgtaccagatgttttgctgtacactttcagatgcatttcctaaattagctaaatattaccaataagtaggtatcagtatccctaatccatagtcaggaaatgatggagtagaaaggtttattaaaattggaatatctcagaagtgaagatctctatgtgaaataggagacaaatcatatgttccaacagcattaggaatcaagtagtgaaaatggcagagctcccatattgaatgagaaagtgattcttggcagataagacaagaaaaaaaatattcagagtgcatggtaattattgaataataacaaaaagttaacctggaatgattgcattattttcaagcactagctcaaccataagtgtattcttatatataaggtctaatgaatgctttaatgaacaatagcttttcattttgccaaagatacaggaatatggttcaaagtaatgttacctacattaatcctcactagagtttaaccttaacccagtgaaggttaataaggttccctatttctataaggaaactgtactaaaataatgtctcgtactattttacaattattttattatgtgaaaactccatgctgggaatcactaccaaagactaatttaaaactaattatttcagcattaatctggataatgatccataatgaatgaaaaatgaataatctgacatttcaggggttccctactgccccaattcatatacaagaaaatgcttttgctatgcctttcatacatagattaaaccacaatctaaaatatcccaaagtgttgagatacttacaaattatattttagttatttatagactagaatgcataaatctaagtttcaatgctgagttaattaaggaaagtccaattttataacattatttttgcatgtggaaaaataactaatacataatgcttgaccatatggtctgttagtccttttgctaattacctacaaatcactacacaggttttacagctgctatatattattaactgtagcatgttttccccaaagattttattcctctcttcatacatttttgttttaactatgtacaaaacaagttcgtatttttaaaagagtcaattgcagaagactgaatacacaacatatatatatttaaaggaatgatgctttacatttaaattaatgttaattaattgataaaagtttcagcagaccaaaatattgaataattttcttttagtcaacattttaaaattcttcattaaagtctggtagcctacgacacgcaatgctgcagtcaggcattaaaatgttgtaataacagtttctgatatagaaagcaattagctgtttaaaaaaatgatgtatttcatataagccatatctaatttgggacatgtgctttaaacaatgttagaattaaatctgaattttgtcacagaatctagaataattattatgttttaaaagtataatgactgaatagcatgtcagagaaaatggcagaaaattaaaattgaaattgaagtatataattcccaataaaatgcttgcttctatcctcctcagaatactttcattacattctacttctttatccaattggataaactacctagctgcagtgtaaaatcctactgggccaggattatgactgattcatcacatgcgtcaactgtgcacgatggtctgcacaagtaggtgctaaaggtgtttgctgaaataaaagatccatacttttcgaatcaaacaagttcttactcttacggtgcacacattgatttaccaccttagtcatacagtaatagtgtataaaagccaaaaagattactgagtatataaaataattggtatctgaaaggcccttttaactaccaactataaattcttccctaagctttatactgtcctgccaagctaacaggttttcttcgtactaatgctgcacagatcttcagaaaagctgctatcaattactttgatttcccaggctgcccaaactgctaatggaatttagtaattagagttcttttgaaacaatcccaaatctgagcattctgcctgattacaagcagccatcgacattaacatcaatcgttgacaacgtaatatacattggatgtgccagaggtaatcattatctaaaatcctgtttctagaacatgacttctatctagtgaagaacatgtaatggggatttaagattcttctacctccaataactgattctatcatgaatcttgtatacagcattcacaatcagaagcaaagatatctttatctgtaatatttccagtcaatttcatagaaaagagccttgaattctgtcaccattttaagaggccattttgtccacatcttccctttcaccaaaaatgtaatcagatatcaatacattgtaagcatgatactgtcttacacttgtatttggaagcaggttcccaagttgatgatgagcattcagaataataaactttgcaaccagaattgctaacttgtaaagccaaaaatcaacaggaagcaaaatgagtctgaaaagcacaaaaagtaaaaaattttatagaaccatttgcccacagatcaaaaggaattttgatcaaattgactagtataactcaggaaattacagttattagtccttaagcatttccggtagaattctcatcttttccaaagcttcactcaaatacaacaggtcataagacctcacaatcttctcggaacactaatggagctgccacagtatttgaaggacatggtcatctactgtgtacaatgtttctggaggaaaataaaacttttagagcagagtcatctgtattaggtatcaatgagatgtcaggccacctcaggaatgactgttccactacagtccatgtgcactcaaatatattaaatagtctataaattcaatgtcaaaattaaattgcaactgtcaataaacacaaatagaggactggtttattacttctgttatattaaccagcttttccaactaaaaactgcaatactaactctgcgttctgcctggaattccttataagaagggtgctttaagaattgatttttagtgatgctgagcattttttcataggtttgttggtagcttgcatgtattcttttgtgaagtgcctgttcatgtcctttgcccatttttaaattttttttattgtgttttgcttcttgatttgttagattccctataaattctggatattaggcctttgtcaaatgcatagtttgtaaatatcctctgccattctgtaggttgtctctttagtctgttgataatttcttttgctgtgcaagctcagtagtttaattcagtcccacttgtttatttttgttcttgttgcaattgcttttggggacttagccaaaaaatttttcccagagccaatgttgactagagtatttcctaagttgtctttcagaattatgatagtttgaggttttacatttaatctttggtccatttttagtttttttatatagggtgaaaggcatccaggttcagtcttctgcatacagccagttaatcaacagataaatgcaaatcaaaaccacaataagataccatcttataccagtcagaatggctattattaaaaagtaaaaaaaaaaaaaaaagatgtggcaaggctgcaaacaaaaggaaacgcttatacacttacacactgttggtgggaatgtaaattagtccagccactgtggaaagcagtctggagatttctcaaagaacttaaaacagagctatcatttaacccaacaatcccattactgggtatatactcacaggaaaacaaatcattctaccaaaaagacacatgcactcacctgttcatcgctacactattcacaatagcaaagacatggaataaactcaggtgtccatcaatagtagactggataaagaaaatgtggtacatatacaccatggaatactacatagccataagaaagaatgaaatcatgtcctttgcagcaacatggatgaagctagaggccataatcctaaatgaattaatacaggaacaaaaaaaagaaatactgcacgtttcacttataagtgggaactaaacattgaacacacctggacataacaatggacactggggactatgagaaggaggagggagggaggcatgggttgaaaaactacctatcggctactatgctcactacctgggtgataggatccataccctgaactatagcataacacaatattcccatgtaacaaacctacacatgtactcctgtatctaagataaaagctaaaattaaaaatataaattaaaaaaataaataaaaagaactcacttttgtgtaactgtaataagaaacagaagtaggtagaaaagacaaaaataaaacttgaaatgatacagaaaaatatgcccaagacaaaaatccagtttgttacaataatatagcaaatgtccttagatacaaatgtaattggtaattctaatataatacaaaataatcaggctaacttctccattacaagtatattttataatcattttcctgctggaaaacataagcaaagctgaaattcaaaggatttgttcagtacaatcccttgtgaaaatattttttcatttaaaatattaaatagtgttaagtttcaatacttgtcatatttaatttatactttatgcatgtattaattttgaatgtatctttagtacatatcttttaggattcattgctattccttacaacctagatgagctataaaatcaccaggctaaacctttaaaaaaaaaaatgtaggccgggtgcggtggctcatgccttaatcccagcactttgggaggccgaggtgggtggataacttgaggtaaggagttcgagaccagcctggccgacgtggtgaaaccccatctctactaaaaatacaaaaaattagccaggcatggtggtaggtgcctgtaagcccagttatttgggaggctgaggcaggagaatcagttgaatccaggaggcggaggttgcagtgagctgagatcacaccactgcattccagcctaggtgacagagcaagactgtctcaaaaaaaaaaaaaaaaaaaaaaaaaaggatccatttagtcactgggaagggaggacttataactcctaaaactccagtttctagagaaattcaattatgtataaaaccggatttccagaacttcacacatttggctgattttctagttgagaaatcatgtgaattcacacaaacctggaggttgcagattgcctgagttttgtcccacttgctgaatgcagaggcccagtgcaccccatgactggtgtccccagaacagtctctttccgtgggaccctgaatgtgcctgggatgacagaataacatgaggtgggggaggaagggaggagagtttgtgatgtgagggatggcaggatgaagcgagggagggaggaacgtgtgtagctagatgagctaaacaagagactaacgactggaaaactatttttcaacattgccctagacattctaggtgtgagggaatttaaataatgtttaaacattaatcacttctaaataattagaagtggaaaacagtaaaggagaaatgagacagttacagagactgctaagtacatgaaaaatataccacacggtcttgtgtcaacaaaactaaccagcattttacaaaagggctccagtggggatgccatttctttaaaatagtgactcccctgaaacaaaaaagccaaagttcccagaacagcctgtgcattcacctctccatacctgggctttggctgttctccagggttggaatgcatctgcaggtgtggacatctaccctcacaggcctccctgtctaacccaggggccagcaaacattgtctgcaaagggccaggtggtaaatgtttttggctctgtggcctcctgatgctgctggtttctccctcctcctcctcttccttccccacccttaaaaaatggaaaacccaggccaggcatggtagctcacacctgtaatcccagtgctttctccaaggcacaccctgaggactcaaaccacagctgctaggaagctccctgttctgctgtttctaccatagctgtgatcacttcccacagtaaggatacagtcccatacactctcctgcctctctcctccagcatgaatgcacacttcttcaggcagagctttgatgtcttatttagcttgtatcaccagccactagtgcaatggctgacacgagaagagtgatggacatttgctgttgttgctgttattgtttttaagacggagtctcgctctgtcaccaggctgagtgcagaggcgtgatctcagctcactgcaacctccgcctcccaggttcaagagagtctcctgcctcagtctcccaagtagctgggactaaaggcacacgccaccatggccagctaatttttctatttttagtagagacggggtttcaccatgttggccagcatggtctcgatctcttgacctcatgatccatcggccccggcctcccaaagtgctgggagacatatctttatttaattaaacattcttagactccagttttctcacctgtaatattaaacatttatgttccttttaatctctaaaattccctaatttcacttttgagaagttcaaatactgtatcttacctcaagtatttaaataatgagtttaattcttaattctgcctataccaaagaacaaagtatctttttacttgacttgatttcttcctttcatgcaggacagtcctgggtgctcacaagagtcaagtttcacacacaacagctcacggggtaacagccttttatatatttttcacatgtggaaaatgaacatagacatgggtcttgagaagggtaatcaactgcattctgagctaggcattcaatttccaaaataataaatttcctctatctttagtctctgttcccttcccctctttctcattctgggtattttaccagaaaattagaagtctttaaaatcaaatcagtgcaatgaaatgtttggcttttagggtgaaatcaccaatgtgattatatggcaggatcccacatactcaaaaggttcaaatttgactttgcttgattttatatgagactgttagtgtttctgatgccatttttaccctgaaattcaaatattctccaagagtagaccttatgtcgtagctttgttaacattatttcatcttgttattaagttttcttattttattataataatattattaattttcattactctaagaaattatttcttaatttggttgacatttaggtctttcaactgtcattatgatttaagagtttgttgattctcagtggtaatcatataaaaaacagttccaaggaaaacaatttggtgatgattaacagcctctgatgattccaccaataattgtacacaggcagatctgtcacttgacacaagtgagtgcctcagtcacatgattcgcttccggtttgggggcttggtagcctggtctattttgtgtgcactgctctcaaccataatggcacgaggcatgtttggagaaaaagcctcccaaatgaaaaccattatggcatgaggcacgtttggagaaaaaggcttccaaatgaaaataactacttacaaatcatccttgggttaaggaattctgtaaaaattaaaatggttctgttctcctgagtgctgtgactgaaaagtagtggaaattataaaaattaaatattctgaaggcacttgccaaatatcagcaacagctatatattacttacatagtaatataatttgcccacaaaaaagttaatgttaaattgctctaattttcatatactcttaatcttattattggacaatacatttgttttttcttttgcaacaagtcagtagaaaaaaaaaaaatcttagtgacataaatttttgctttaagcccaacatgaaataaatagcaccaaatgtttggctaaaaatagctttgaaatttttgagccatctccacctcctgtggagcaatgtgggggagaaataaaccaaccaataaataagatctagttctgtttctaaccttcccattttacaaatgaagaaacttggcacaaagagggtaaagagatgactgaaggtaacatgccttgttaagggcatcttaatggaatatattagatgaactcaggcaaatctatgttcctgctcaagatcactagagaagttttgtttctgttctccaagttttcacattaacaaccaagagacagtgacttgtgtaaacagtgacacaaaatgcagacatttggtgaatgaaacggaaatgaaataaacacccataaagaagcaaaacaactgggcatggtggctaacagctgtaatcccagaactttgggaggcggaggcagaaggatcccttgagtccaggagttcaagaccagcttgggcaacatacagagactcagtctcatctgggaatggtggcatgcacctgtagtaagtcgggaggccgaagtgggagggctgcttgagcccaggagctcaaggctgcagtgagccatgacagtgccactgcacatcagcctggcaacggagcgagattctgtcccaaaaaaaaaaagatgtggccaggcatggtggctcacgcctgtaatcccagcactttgggaggctgaggcgggcagatcacaatgtcaggagttcaagatgagcctgaccaacatagtgaaaccccatctctactaaaaaataaaaaaaaatagccgggcgtggtggcgggtgcctataatcccagctactcgggaggctgaggcaggagaattgcttgaacccgggaggcagaggttgcagtgggccgagatcacgccgctgcactccagccctggtgacagtgcaagactccgtctgccacctcctcccacccgcccccccccccaaaaaaaagcagcagcaaaataaagttagagacatccaccatcagattgagatttcaggaggtcaaacttgcaaatacacacactggtgcatacacacaactccagctgatgaggagcacaaccaaatattgcttaccattctaaaattctaaacagtagggagagatcaaagtcttacatgagaaacccctgagcacagctgacaggagctggacatacaggtcttcagccagtacggaagcagggctcgactttgaccttcactttgagtcccatggacattccttctatccacacagaatttctagcttgaaatcaggaagaagtaaaaactttgacctcatatttgacttctgtattctcttttccctattaactctgactatcataaaatacaattaaattaaaattatatcttaattaaaacaataattttaccaaatccttgtaaatttggatcattagatgaatgagaaacttgcttttcaccatttagtttcagaacttctttaaaagtcactatttcaaattacttattcctaaatttactttgttgatactgattttcatgcattcatttccaattatggttgaataacaggaaatacaaaaatttttctgcataaaactatggccctaaagcattgaacgccaatgaatgattgaagctccttgaagaaagcatctctaaaagccctcaactgtcaatcctacaatataacgaaggcagatgacattctcagattcctttatatagtttctttcatagtttcattttttaaaaaaataaaagaaatgctgaaatgtgaagttccttttcagcatgcaatttgttctaatgataatgtaattcctctatgtaaggagttccatattatttctttttctccacactgaactgtaagacaataatattatccctatgtttattactaccccttcaactttatgaagcacaaaatgcctcctttcctgttttcttgacgtacagaattttgcttcagtaagcctaagagtttttttccctagcctgtatacgcttgttctgtgccaactcattgtaaaggagccggtttgaaagcttatcaccattaattctgtgactttccaactctgtctccctggtaacagaagcctacaattacgagacaagaacacaaaggatttgccaaattatctaaattctaatactctaacattttatacccttccgcctcccatccatgcatctattgtttttcccaagtctaaagcaatggtcttcatgttagcttctctatcttcagttttcctctggccaagtcatctaaaacacgcattccagttgaatcttttggaaaccttaggactgtcattcttccataaaaaactttcactgcgccccaaaactctcagagcaaagtacaagtacttccgtttggtattctaggatctctatgactgctaactatcccttttttttttttttttttttttttggcagagttttgctcttgttgcccatgctggagtgcaatggcatgatctcggctcactgcaacctctgcctcccgggttcaagcgattctcctgcctcggcctcccaaatagttgggattacaggcacctgccaccacacccagctaattttttatatttttagtagagacggggtttcactatgttagccaggctggtctcaaactcctgacctcaggcgatccacccacccgcctttcatacatatctctatgcttctgtgactttggccactatacgagctaggtcaagtttgccagtcttcctgtgtcttgctacttcacattgctataaacattcttaagtaaacaaagctctgttttgaattaaacatttccaaagcaaagtatttcactagcttcctgattcaccgcatgcttatccctaacaagtatgcttattccttaggattctccacagtcaatggcgccatttccccagttgctcaggcctgttaaagtacgagtttcaacaaagcaaaatcatgattcctatgtaataaaaatcatgtctcttatgtaaataaaaaatgaatgtgtgtcaaagatcttatacacttagtaattaatgaggaagccagtaagatgttaaaaccagttgaaattaaaatttgaagaggtaggtgtttaaaggcaattttacaaagtaattttatggtaagatcacctggttagatatattaataaaatgggataatgtccaacagggcaataaactataatttttaaatcatcttttccaccagatagaaattatctgtatctctactagacaaaaatctgtacattcaccccttctcctacaaggttttacaacacccaaagcaacagaaaatcaaaggtaaaagcctacactgaacggaaaaacactcagtagttgctccatttttgtttcagaaaacttttctgatattctaccccttatgattataaataatcctcaaagattatctttaaagaaaaagtctagcctcattaggtttggtctaattattcacatggatgcaaggcaacaagagtcctaatcaaacacacaggcctcgagtttgatctgaaaatctagagccttatagtattgagcaactatgaaagattaagaattttctgggtagatttttcatcagaggtctcagatttgatttttattatagtcctcatatttttttatgctgagtgtaggagactcagcccaagacgttttctccagcagattttatatatacccataaatctgggtgaattcttctcttcttgatgacttccaaattctctaaggcctctgatctggtaagaaatcataccttctgtgaagctgatgctctgtaagccaagtaccaagtgccaagccagggttcttgggagactctgtaggcactgaatccatacataactagtcttgagaacaggcttccaactaagaacttgctctttaatagggggcttttcacagctgattaaatgagaatcattctcaaatgcgatattgcttgcacaattgatgtttccaattatgctctgataaaaagagagcaagattcttattgaatcttacccaaataactatattgccaagtcaagtcacaaatcttagtaacatagctgtttctgaattctaagggatgagtgagaatgagataccactaaaaatgtttcactgcagtttaccaaagcatagtctattaaactgaggcttagagacagcttgggaaaaaggagaaagggtttcctcatacaaccataaataagagagcattccaacaacagcaacatatctaaacaaataaccacaattaaattagtctcatcagttcatttagtccttagtaattaagttttattctgctggatactgctttcataaagtatgtctgctgctggactgaaagaagtcctggaaatccttagtcactgatacagtctgcaagttgtctaagcaatacctgtttgtaaggctgtgcttgacaattccctgaaggggcaatggttcataatgctggtacaggcctttccacaggttctgaactcccctttgctaaaggtataaactctagcctgaagcttatagcaaagtcaccaggcaaacatcagaagggaaaagagctcttgcttgatggtaagactcatggcgaaggtcatattccaggaacagtattatcacagcaggcaagagtaaatttcttttttgggatagaggacataactatttcataagggtttcccctgagagagaagacatatgatggatagcagaggcactgacaatttccagggtcttctcaaaatgtgtacactctataaaatatttaaaaaaatgaataacattttacttatacaaatttaacctagtgaaggttaagcatctttcctgatttgacaactatcttcatacagttctcacaatagtttgaggtaattaagacatatggaacccatgaaacaaacccaattatttctagtattcttttacttataaagtgaaagaataatctttatgaggccccctcaaaacacaaagatagcattagatgtaaaagacattttacactgaaattttttttttctaaatttgcaatcaaattgtagaaggcaaaaatcaaagtgttgtcagaggaaatttgctcactgaattaggatggaaccatgggggcatgagaaacagtatctggttacctatttaatcaacgtggcaaacagaagaaggcacacaagtaccaggaaacttcagttctttactagtgaggaactttggctcactgaacttcgtgtttgtttacatttatttatcttgttttgtttttgtaaataatcaaggacatgataaggtccacacaaagttgagatgcagaatccttgctacttaggcagattactctgcaggtaaagaatgatcttttgtcactccatccgccctctgttaactctaaggccaatttatcattttaacatagagaagtcattttctagttttgttttaatgtgaagtttggcagtaaagttttcatgagctccttttatttttttatatcttgtgaataattctatcaaaactgaacagaatttaccaaaaaattaacacgtttcattatttctttacagattcagatattataaaaacaaggcaaatacaatttgtttcctcaaacactctatagctagctctccacactcattattctcttcatatgctggaatacactaatacttttctttgggactagtcttgttttttatttgtttttgttttcttacacaaatgcacttacacagttgtgttccttgtcataattcctccttgtgataacagtagtcctaatttttagcagatattacaacttctatttcatagacaaagctgggtgggagataactgagaactgtcatagacagcattttagcagactagcaaagctcaaaaatacacaacacataccttcctaaagccacattcatcctttttgcacattcttaaagtgacaaaaaatgaacacgtttaatgatatgatccataaaataagaaccaaaaatattaaaaaattaacatttgcttaatgttagttcttataatgttctatcttagaaattattcagggatctaaaataatactgattaattagctcaatttaattttaatccaaattttgaagttactctgggccttgaaattatgtttaagctaacattctataaaacataatcactgttataaaatcattggtcaaaactgtaattcaatatatttgaaaacatttcataatctcaaacattatttagaagtaatattatctttttggttagcaaaccaatataagtatagtagtgtcgaaaactcagactaagtagttgcttcatgagaaaaatttaaatcttatgaagaatataatatagtatattatacttaaaattgaaatatcatagaaaagttatataacttttttcttaagaaaaatgattaaaccaatctaatcaaaaattcacctcatgtgaagtcttaaattgtttcttttttagtagtttctgtaagaatattttaagtctagtacaatattaggagatactctgaattttctaaatttcttatattgaacataatttaaatatgaatatttactgaattcattgtaagacatagtatgattgaagaatataggatatggtggattgcgacattttaaattatgggtttaaaagttttgtatatccttatctattttattttctaagacctaaatattaatgcactgacacaataactaatcagaaataaaagttgacatagacataaagacaccacgggtaataagaaagaacaagcagccgggcgcggtggctggcgcctgtaatcccagcactttgggaggctgaggtgggtggatcacctgaggtcaggagtttgagactagcctgggcaacatggtgaaaccccgtctctactaaaaatataaaaattaaccaggcatggtggcgcatgcctgtaatcccagctattcaggaggctgaggcaggagaattgcctgaacccaggaggtggaggttgcagtgagccaagatcatgccactgcattccagcctgggtgacagagcaagactctgcctcaaaaaaaaaaaaaaaaaagaaagaaagaacaacaagcatatttttcactatgtgtaattattttaaatgagctgtcacattttaaatttacctagaaattagaccatttgcaggcccatttcggcggggaggcagaacgacagaaaatcatacacattttccattaatggactcttgctgtgggaaagggtgagctgtcctgaagacctctatccagtgttcataagtttatcactcacctctaataaaaagcaatcactatgtgaatttatagaaaatattaatttcatgtttatttttagcctatgaatatagtggctttcattaatatacaatgtatttttatcatttctgaaaggtttttatccagtgttttgctgaagctttttgtcttctgaagtacactaaattttcaatttaataatttagttcagttaatactcattttacttcgtgtagtaataaattattcaacttattattaccttgtggacttccataatttttcaaattgtagtcagcaacactgtctgcagcagattattaagtaaaaccatatatagaaaacatacatttaatctttcttagatactgtttcatgtcttgctaaacagcagctttggggccaagcacagacggaaattctcccaagcccagctctacctcctctctgactccaagtaggttgaacgctcccactttcagcacattcagtcttttggcaatggagatgcacaagttgcctggaatcataaaaggctcctcggcttgcctatctttctagttcccaggaccctgcctgtgctcctcctcctcctgccacccagatatggctactaagccccaccctcacagtccacaccatcctccaggcagagtgcaccccccatggaaggctctgagctggagaagcacacaccaccagtccagaccacacttggcagtagcaatcagggtcaaaggttaacatgtacttgcaggataaaaatggattctgtcttatactcagtatctaaagatagggctggtgatcaccatcactggagccatcatcactgccagcccgcacagacctaatccctccctgggagaatatgtatctgcagcctaaagtctgaagccttttcccaaagccttaaccttccataaaaaataaccgttgaatattttcagaaaggcaggcactccccacaaaaaagaacaagattcccataaatacggtggtgtatcccctagctggccctaattatagagccccaattttcttagtaaacttgtagctagctaagtaccactaggcaatgctaacctgatgccatttatgaaaaataaatttcagagatttattctgtatgtgtgtatttaaaaatctgaaagcaatacggtatactgcaaagaatatggtttggaaatcctatagatttggttgaagtccctgcactgacactaaatagctgtatgttattggaaaactaccaaaagcttatctaagtaaggcttagaaaaaacagtcaagttattttcatgattaataagatgcatatagagaacttagcatagctcttagaatatagtaatagtcatagtttattgagcaattgctattaatattattgaataccatttcagtgtattcaacttttctttccgtggcttattaatagagtatctacttaactgcatattcaattccatgtctttatttttcatattataacattgtccatattaaaatggctttatttacaattttgttgactactattctattgaatactgacagcctaattttatgaaggtctgtgacctttgctatcttcctaacatgattctttacaggaaattacataaaatatcaaaaaaaaggaaaagaaatattgtaactattgcagcctcattcatggaaaagacagggtacccaaactaaaaatccaagggatgaaatcttcaaggacaccagctgatttttgtgcatcaagaagcaaacagtcactcagttatgcagctgagctatggcaaaccttacctgtcttacagaagacagctaagagctacaataaaagaggtcaattgcagctcttctttcatagagttttctctttcatagcatggaaaaaacaaagtcagggattccttaattatttctctgatcctataaattttttgctggcatagttgtttagctgtatgggccactacatgaaatgctaaggaagaaaaaaaaagtgctttttgaaatactcaaaaattgtcttttgaaaactaaattgtgctttcaaggaaaaagtattcacataaaagtaataatcaacaaatcggatataactgatgagattgtttgatagccaccttgcttctattcacgtactctacgtgtcttctcaaaagactcccaccaaaccccattcttgtcatttccagaatgaaaggagacaaattctgaccctgagccacagtgcataaactttctcttttttttttttttttttttttttgagacagagtcttgctctgtcgcccaggctggagtgcagtggcaagatctcagctcactgcaagctccacctcctgggttcatgccactctcctgcctcagcctccccagtagctgggacttcaggcgcctgccaccacgcctggctaattttttgtatttttagtagagacggtttcaccgtgttagccaggatggtctcgatctcctgacctcgtaaaccgcccgcctcggcctcccaaagtgctgggattacaggtgtgagccaccacacccggcctaaactttctaaagcagattccagttttcccaggtaaaatcacacaaagaaaccaaacatataaaataaataaaaggtttttaaaattaaaatacaaagtttttttttttattttttcatagacagagtctctctcttctgcccaggctagagtgcagtggtgtaatcatagctcactgtggccttgacaccctgggctccagggatcctcccacttcagcatcctgagtagctaggactacagatacatgtcaccatgcttggctaatttttttattataaaaatttttttgtagagatgcaggtctcgatatgttgcccaggctggtctcaaactcctggcctcaagcaattctcccactttggcctcccaaactgcttggattacaggcatgagccaccatgcccagctgaatttattgtttttaaatagaaagtacacttgtgtagcacttaacattgcagatacattctgagaaatgtgtcattaggtgatttcatcattgtgagtacgttatagagtgcacttgcacagacccagctggtatagcctactacacacctaggctgtatggtagagcctcctgctcctgggctacaagctgaacagcatgttactctactgcatactgtaggcaactgtaacacacggtaagtatttgtgtacctaaacatatctagacatggagaaggtacattaaaaacacagtcttataatctcacaggaccactgtcacatatgcagtctgtcattgaccaaaacattattatgtggcacatgattgtattataagaaagaaaacaaaaatggctcataagtccacagccaaggacaaaaaatacagaagtaaaacaaatttaactaggaagctgaaaccatacataaagatacaaaataaagagtaaaagcttcttccccttccctctgagccctctccacaaaggtaaacactgagcaatttctcatcattctctctcttctagagagaaagaataataatataaataataatgtaatataatataaagagagttctctttctagaataatgttgatatattaatccaaatacatgcatcttaaaggtagtattttgctaaataaatttataaattaaatttcaaaatatttatgtgcaataagtaaatcaatgagaacaaacaatctgtttttggagaaaaaacatattaggtcagatgtcatggagggctattttagacttaacaaatcttaacactcattttatttgggtattttaatttggttacttaatattacaaaattgtgattcaaacgcatgagcagatgcactatggaaaggtcttaacagccttaaaaatctaaaatccaggaatctaagtgagaggtagttaagaaagtttggctttaaagctgaattattaataatatatagaagctacctgaatcctttactcatacttatatgtcaaacaagaactattcagggctttctggaagtattaaggtcatgtttcaccttcactttttgtggtacaattaagaaagcatgccagagtttgtagtaattcctgccactcaccaaggaagcagaaagtttgtttctgagctcagtctgatcacaacctcacaattttccctactttatattccttttcttgtctctttcctctgtcaccactttatctatcactcctctattgcaaacaatgaagaagtactttctttctagctatataagatcatgttagagctcccagtgctaggtcctagaaccatctctatatgtccacagtgcaaaaaaaaaaaaaaaaaaaaaaaaaaaagtctacggggcaaaatttgttgagtactagaaaagttcctaaatattcccccacatcacccattcccaactaattacagaaaggtcacaatttattataaatcaacaaatatctgaggaaaggtgtaaaaagacgagcgatgtaaaatggcagtattatataactctactgtattaaatatcacatgtaactacttgacaaaggaaagacagacagccttctccagcaagcttcaaaatgctctgcctaaaaaatagattttataatcacgtttttgtaatatctctctgtactgtgattttacattatactaaatgggattccaatggtcactatgtgtttaaagcatggcagcattctttctatatgcaactcctctgaggtaattaaatccttggtgttctttctttttttatttttttaagatggagtcttgctctgtttcccaagctggagtgcagtggtgccatcttgactcactgcaacctccgcccgccgggttcaagtgattctcctgcctcagcctcccgagtagctgggattacaagcatgtgccaccacacctggctaatgtttgtatttttagtagagacggggtttcaccatgttggccaggttggtctcaaactcctgacctcaagtgatccacccgcctcagcctcccaaagtgctgggattacaggcgtgagccacgacagccggccagtgttctctcttttaaatgtcatcttgacagtttgtgagtaagctccttttaccaacaggcactgatctcatagagtgtgcacaaacatacagccttatatgttatgtgttaacttagctgggctctggtgctcagttaggtcaaacactcacctagatatggctgtggaggtattttgtagacataattaccatctgcaatcagttgactttaagtaaataagtttaccctaaaaaacttgggggtcctcatctaatcagttgaaggtcatatgagcaaaaaccacgtttcttgaagagaaggaattgtgcctcaagactgcaacacaggaaccctgtctgagcttccagtctgccagcctgccgcacaaatttcagccttgccagccgccacaaccatgagccaattccttaacatatatgtatataaacatttctttctctggagaaccttgacggatacacatactaaatctccgtcaatataataatcaacaagtatttattgagtgcatttacatgccaaacactgttctagatgcaggtaatataaccatcaatgaaacagacaaaaatctctattttcatggggcttatagtttagtggtactaagatgactagcaaattgttagttaaggtaaccatataattcatcatacaatccagagcacttttaagataagggtgaaataggatactggtaatgattttgccagggcagcatgtctaacccagagccatctcgacaaaccaggatggtacacatcatctaagtctctagtgaaactgaagcccatctcccccacacgaccatgcatctggctaactgtagaaagtcaaaggtgtatgtcattaatcaaagttgaggaacagacttgtagattcagagagatttgggttccaattctcggttacacattataaaaagtattaaacttttactccagcctgggcaacagtgcaatactctgtctcaaaaaaaaaaaagtattaaacttttatgagtctcaatcatgccatttagaaatccatctaatgtgagaactaatgatacacatatgtacagcatatacagaaagaactggaacctgccagcccttcagtaaagtgcatgtaaagtaagtgattaagccgagcagggctggggattaagtggtgcactgaaaactttggtacatgaatataagtctttctctactactttatttttttaacatatgtgaatgtatgtcattggttttaacatttttgaagaaaagacagaaatctgaacattctgcctgggaattagacagcaaagtgcaccagaaatgatgaaatgatggcaaggctataatttagagcacggacatacgtgactctcaagcggccatttatcactgttaagattgctaaaagtgactttaggtttacctttaaaaagtttcatattcattaaactgaattctacaccaatatataccgaagtagaagctgccttaaaagcaggtccaacaatccttctgccctgctggaaactgttgctaggagacgagagtgaagagaacacttcctctccagtgtgaccacaggagctgcaactgctgcacaccctccacaatgcttttgaagcaggtttgaaaactctctgccggccgggcgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaccccgggaggcggagcttgcagtgagccgagatcccgccactgcactccagcctgggcgacagagcgagactccgtctcaaaaaaaaaaaaaaaaaagaaaactctctgcctatggctgaaacctcagagagattttaacagtctacaaagtatacagatatccctaggtatgatctcaagagtgagaaaagcttccctttgtctcctaatgtttttctccattggcttatcctagagtccaataatctttgtccattctcttggagtcttcctaacaaagatataaaattaagggaactcacagtgaagatgatctattaattctgtgggaggaaggatgaggttactcacatgtaaggacagcatgggtgtgacaactgtttcagaaagcaaagtcccaaatgccccaaaattgtatttatgttcttttgtttgctggtggagagaatgtgagggaatgagaggtcgagaagatctaaggagaggaaagataagaaacacattgccttttctagataggataggccagagcaggagttcatactgaaatactttattatcctgtgagggttagtcaactgagagcaaccacaatatggctttgtttgtttgtttgtttgtttgtttaaactggaaagaaacactgtgtttccttctgattataaatgtaaggctcattacaaacctccattctcctggtacatttttcagaaaacagagaaagtgaaaatctctcaaatgacactgccactgactacattttgatgtacatcttcatcgatgttccctttgcatgatcacacatacacacgtgcacaccgtaacacacttacgtggaactctgtaagtctgaaaataagacaagttccctccatcactataactaatctatccttctgaaaaggagactccatctattcctgtcttcacttcaccagattaccaaatgctctctcaattattgcattttgaaggagaaagtagtttgaggagacacattaacctgaaacaacctcctccgtaccgaattggtaattatttcatactagttacacctcataaccacaaatattaactcctgtaaataagctttttaaggatcacttttagaaagttatactgtgctcacactgacaagatcctcaatatatgcccatgggaagaaggaaaaaagcaggcttctcaggttacgtaagtggatttagagagtgctctaactcaagcaactttaggcagtgctggtgctgacatatgtgaaaagtgtgaataaaattatttcatgataatgataaaaataatatttctaaattgctatcttttttgtatagttgattttcattcactaataaattaattgttataagtagatagttgacttttgcatctttatccctaaaatttcatatgcataatgtgggccacatacttttaaaaataatactcagatatttagcattaccttatgtcgagatttctcaccctcagtactactgacattttgggtcagacagttctttgtcattgaggtagtcctatgacttgtagaatgctcagcagcttaccagacttctgcccactggatgccagtagcacccctcaatgtaacagccccaaatttcttcagatatcatcaatgtccactggtggcaaaaccgccccagttgatctttatatttagggtcacctcatatttgggcatacgtggtgtctagcttgcctttacaaagctggatcctaaggacacaattttataacctgctcttccagctgactgatatgtcatagcgatcttctcagctcattatgtacatactttcagtgtgttcttaactgctgcactgtgcctcattaacaggttgtgtcacaagtgttgtatcagttaacaattgtttccaatttctcagtaccatagtctctatcatttcatatataaattcctttaaatatgttcaattagttccttatattttaagaccaatagtatccttagaattcattttaaatttagtttaaatatacctgaagtcaaaggattaaaaaaagcaatacaacacaatataaggtcaaaacaaatatattttagattgcttattatttatggtttctacccatgccactcttctattagaattgagaccagccaggtgtggtggctcatgcctataatcccagcactttgggaggctgaggtggaaagactgcttgagctcaggagttcaaaaccagcctgggcaacagctgactgacacttcctctttattaaaaaaaaataagaagaagaagaagaaaaaataaatacaaagaattgagaactaaccccccgataagatttattaaaaattccttctaaatgactaaaagctttgctttttcatcagtattctgagcatctttttcaaatacaaaagatataaaacaggcctttcagagatccatatgtaccaaaactgtatagcttctagcatcttttcctttagaaactctatgtgataattcaaaaccaaaaccaaaaatctagtcaatcaatgatttgaagatattttattactagctgtcataaacaattttaagtgaagtctttgggtttcttgctctagagaattctaactgagtttaaaagatttaaaaatcgatgattgcattgtttttggattcaggaaggatatacaaacagtttaatgagactggaaagaggtccaaagcagtttcaactgtacctatagaacttcttgaaagcatttgctaaagcaaatatgtcaagacatgaagactgattaattcagaatgggagtttgtgtttgtgtgtgtgtgtgtttgtgtgcgtgtctgtgtgtgtgtctctgtgtgtataagcacgttctttgaaatattttaaggatttttcataataattttttaaaaatcaactcataatttaataggatgttgcaaataatcttctcatagaaaatcttagaaaatttctctggaattagcgttaccttttcaatagacaaaatgggtaaataaacattattttggtaaattttgtgtatttggaatcttaggtgatagaatttgtttccagacaacctgggtctgatcctcaattccttacattcacattgaattatttatatggttatttaatttttttctgcctaagttttcccttgcataaaagacaaatcgttataatatctacttcacagtgctactgtgagaatagcagaggaaatgtttataaaaattaccttctaaaatataaagccacagtattctaactggttgccaacagtatctaaatattcttcatagtagttaaaacagattaagaattacagtgtattattcctcagtgttgagcatggccccttttttatcttagtatttataaaacaatttcaatgaataaccatttatacacatacaggcagaaacaaaaactgctttctttgttcaacaagtacctactcactggcactctttttgaaggcagagaggactttaggtacttcacataaagtaagtggttttgtatttcacattatttgagcctatcaaaaaccacatgctataggaaagaatgatcttactaaatctatttcagatataggaaaacagaagtgtcgaaagttaagagacttgtttaaagtagtgataggatcaagtctaacagtcgagcttccacatttgtgacaaactactttgctattattgtagctctccttctggcccactgtgaaaagccatgttcatacacatgtttttaacagttatcaagttatggattaagaaatatcatcctatgagatgcatattaccagtatccccatttcatacaaaggaaaactgagggatagagattaagttatttgcataaaatcacacagctgttaagtaacagtggcaggttttgaacccatgttacctgcctgaggagcccgagttcccaaccacgatttgtgccacacacattcaactggcattagataacaacaatctattttactgtatcagaatatgattaatttatctttcttcataatgataaaagattatccaatagcatcttctaaattgacatttatccttcaaaatttattttcaaatcttctgattcattcaagagaaaacaattttttaatgtttactgtattagtccattctcatgctgccagtggagacatacctgagactgggtaatttattaatgaaagatgtttgattgactcacagttccacatggctggggaggcctcaggaaacttacaatcatggcggaaggggaagcaaacacttctttctaaacaaggcggcacagcaaggagaagtgcagagtgaagtggggggggaaatccccctataaaaccataaggattatgggaactacaattcaagatgagatttggttcgggacacagccaaaccatatcatttacttaaaaaaaaaatcataatctttcaaacaaaaataatgctctagtctttttaattaaaccccaatatgattttctaacaattctgtatgcatagttataccaatgtcaattttaataattagaaaatgctattcatctttttcataaatttcatactttaattccacaaaaaataaaaatatacataatttattattacaatatattaatgattttggcattctgatctacaatatagttgttatgctttaaatatattatcacatttgtattgaataaaaccctgagctttatccgccatgaagtctataaaaaaggaaaatcacaattggattaacccatgagtatttaagaatttccttggtagttttttgattcgtaattgtattccaacactttcacaagtaaaccgtagggatttttgcctccagaaactttatctggcagcctagtataactgtgtggtcttccagaaacaatcgtgtctcctttatttttttaagcgtatatacaaagagagagtatatacaaattaacactaattagcaagtcagaaaagcatgtttttctccctagctcttatgagtgttcatatataatttgctccaaaagaaattttagtaagttacagtactgccagaattactttaatttgatggttttaacagggaaaaaaaggaattatggaaatcccctttggaattcaatcacagaaaggaaagattcaattacttggaaggtctttggcactgtgagatagatatacagaaaatgagagccacacttgggtcatcattaactgtaataccatatggcatttcctcctctgagcttctgctaccatctatttacataaaatatgagctgcaaaccaataattacaaacacacatacacacataaatgagagataactatgctgagtgaaatgtaaactgacttttaattattcattaatagtaatttagaatattaaggggcatgacacaatgttatcctcagggtccctatacaccaggaattcacctcatttcagattaacaacccagtataaaaaggcctattaggcccaaattatataaattattcttgaacagaataggtccaatatcaatctatatgattctaaatgctaatctacattcaaggactaaatggcacaaagtagagcgtacatttacaacagtaccaagcacataggtggcattcgctaacaagagcagttacagaaacattctctctactggcaacttttcagctacatatgtattaatttaagagcaagaactaattcgggatatagagaaacacaacccactctcagtacttttaagtcaaattgttgatcatcaaagattctacaatgagctttaagatccttctcaatctgtggccctacgcagccactaccaactgaatggagctggcaggcaagatggaagttatctgacattttatgatctgtgatctcatcttctcccagaaatcaggatgctagtgaatggcctcaccctccatcccattatttaagctaaaaggtgtatgtcatacttgaacctctctttcacatgtagtccacattcaatccgacaattgaattgcctttctaggcattgaatctatcccattagcactgtctctgccatagcacatgaatgcaagtctgtaattacctcctaccattctttcctgtcccctctaacccttgctcctcactgcaatgagagtattagttttgaagagcacatataatcttatgaccaccaccatcccaacacaatcctgaaacagctttacattcctcttgatcttgaacacagacctttatccttaacaagaccttccaacagctggccttccagatgtattccagcataagacatactccttccctctcccccttgacactccagccatactcctctcaatcccaggcacccaccctccaggtactctcctagcacaaagccttagttaggagctttcctcttctctctgctttgttaaacatctactttcagaactcagctacgctgtcccaggacttctactttacagatgcctgtcgtatcctgccaacttgccataagtttaattttactgacccttgaggacaggggctaaatatgtggtgggcttgttcatattatatgaacaccacctagtacatggcctagcaatggtagatgctaaacaaatcctgcttaaaagctagaatgaatgaatgaaaaaatgaatacattgatgcaattatccatagtagattattatatccttgacagagccagtgttacagaagagttggctcctaattaaacagacatattttgtatattatatatagtattctattcatttgatactattgcatttgttcagtattgcagataaattacaaattaactgcagtaataattacatgtgggtatgatcaaaatccccaaatctatattaacaaacttccttaaaatcaaagttgagtaaatttatatcaactttccatcaatatgtgttttattacattcatttaataattccaacaattactaaatttaaaaaaatacaggaaactaagcaacaaaaagttctcttaagagttttcaggacaaagaatacataatgtttcatctgctaaagtagcaccctggcatccaaaagttgtttttgccatattttcaatgataatttttaaaaattacacttggtaaattcaaatggctgaaagaaaacacctgtaataaatctttctcatggaaatccacactgaaaattagtggaagaccctccatattgtagtcagatgtgaacacccctgtcatgactcatgactgctgccatttcagtatggtctggtgtcagaatatagtagggacatgagggttccaggcctagcacaagcaccaaattactggcaaacactgtcactggaggcttgttggaggcttgtttctgcaactcaaaacctaaaatgacatctctgcctcagaggattataggaagaagatgacataggtattttagaattcttaaaaaatataatactataaaatgtcaccagaacaattctgagattttagagtcatttatgacaaggcatgcaaccagattgccaactcttgtggcaaaatcaaacctctgcatggtacaacatccccaaattccacataatttaaccagatgcacttaaaaatcactgcattgcattggtgccacagttttttgttcctatacatttcttacaatatattctactggtcttaaagaagtttgtactgagcaagcatcatatctattcaactttctttctgtagagtctagctctttatgcaaagacatacttaataaaatgcttgtgaagagtcatacaacgagataatatttactcaaaataagacaaataatattctgcactcatagccatagtaacctatgatataagaaagtgtgttagccgggcatggcggctcacgccagcactttgggagaccgacgcgggcagatcacctgaggtaaggagttcaagatcagcctagccaacatggtgaaaccccgtctctacaaatataaaaaaattagctgggcatgatggcgggtgactgtaatcccagctactagggaggctgaggcagaagaatcgcttgaacccgggaggcggaggttgcagtgagccgagacagtgccattgcactacagcctgggcgacagagtgagactctgtcaaaaaaaaaaaaaaagaaaaaaaaaagaaaaaagaaaaagaaaaagaaaacaaaagaaaaaaaaaagaaatagcctgaagatctgaacttaaatcatctacacatcccattctaagcactaactaggtacttacaatgccaatatcatataagtcatgtgaattgcaagtacaactcaagacaaactatattttaaagatatttaagaaggatttttaaatgggtgcatgtattttaaaatgttatgacatttaaaacaagtccacgtcttaccgattttttagtagtaaaaagaagaaataatacattctatcaatatatacctttggaaagaatcaagctgtaaaacactgaaaactcttcaattttcataggtaatagtggctttagggctttcaaagtataactttttatggattaatcatttgcaatctttcagactttgatcatatattatgaatgttaaatgttataatacctttcttagttacatgaattcaagcggctgttattctataattctaaatacaattcatttctggctatgcctaattttacactttatgccttttttcctttaacttaaatatgttgtttggccaacttccagctttggatttttaaggtttatattggaacaagtttcattccaatttgatttgtgacagataacattgtaagctacttttctatattgcctctgaaaaagagctatttccattcctacacagtatacagattaagaaagttaacataagtaatgtaccactataatttgaaaatattcatcttgttcacgttctctagctcttactaagagatttataatgccactgaaacaagaattgatgaattcatcactgtctgggacattttgatcataatcaataacataattttacccttaaataggatttcaattaatgcatatttttcaaagcaattttcctttaaaataaaatgggtttttgtaccatgagttattaacccattaggtgccaaaaagaaaattattctgtctctgaagttctacatcagaaaaaaaagaaatgaaaccaaactctgttctattatacatttcccacaggtacatttcataaaaaattacattattatattttcatcatggaaaatgaaaagtaatatactttcgtaaaatgatagaaccatgaaagttttattagataaaagtgaggacacccaaatgcattgctactgcttggacagagtatatttatcagcaaagaaaacattttcatctaaacaaaatttatttgtcatatcattatgaaacatcaagaacaatattaaaaaccctgtgaaacttatgccaggcatacaaaatacactctattttatgataatcctcctatcctagccatttcatccattattttcctgttctcactactagaatgttgaaagaacacagatttctctcacacacaatacaaaatagcttccttcaacaaaaataactcaaaattcaaaaattattttaaatgtatagtataatcattttattataaagaagtcaccctcatttttttaagcttcaaagcatgtcctctactttactactttctcagaaataagcctaagtattttaccccttgtttcaatcacaattagctggttcttgctaaatgattcagtccagctccttatgaaagcatgcaagaggctcacttctcacctttccttatgcagtgttctctagttctgcccactaaatctgtttcaccatcacactgtgtctttgtatgcaatttcctctgcatcttctccccttcccatgtagaaaatgtgaactgatccttcaaaataaaaaacacacactattttctcgtagagtcttctatgacccccttggataactgcttccttccctatgattccatagctatttatgcagacctctgagacagtgttcaatttgcattctaattatttatctacttgtttgtccttcctacaagagtaggaggctcctggaggtagaactcattggtccttctatcactagtaaccctcaagattcggtacctaagacattcaacaaagtaaagagatgggatgagtgattgctgtccacatggtctgttcattgatcttaaaaccgtcagccccaaagtagggacttgccaattatttagaaatgcctatctaatctttctactgtattcaacttgtgtaggagagttcaagttcctgggctgggtactcaagatgtttgattttcaaattaaagagatgaaatttatgacactaagaattctgggtgctgagcaacaacattcaactaagaaagaacaagggagggccgggtacggtgcctcacatctgtaatcctagcactttgggaggctgaggtgggcggatcacctgaggtcaggagttcaagataagcctgaccaacatggagaaaccccgtctctactaaaaatacaaaattagccaggagtggtggcgcatgcctgtagtcccagctactcaggaggctgaggcaggagaatggcttgaactcaggaggcaaaggttgcagtgagctgagatcacgccattgcactccagcctgggcaacaagaatgaaactctgtctaaaaaaaaaagaacaaggggtcagggagcaattggccaccactgacttcagtatctcaagttgagttaggaacttaaagaacaagtttctaatgtaatttctgtaaaaattctaatgcctaaaatgcagcaggaagatacagagattaaaatcaggttaaagcaaaactataaagacaagtagtaatgaggatatacaaggtgcaaagacatacagttcccacggacaatgaggttagtaggggttggtttgggagacctggcggtggccttattaggcagggtggggaaccctgagcacagaggtttctttactagaagtaaccaaacagattctaaactctgctctctaacacttgaaggttcctgtgtcctggaaatctttattcaccaaacgcagtttgttgctttgttaaatatgacagggttatggctgaagtaataatctacgcgtatctatgtatttaacatattctttagtccctcacacttttcttgaagcagaaaaaaaggcacagagaaacagttaaatgtgaggcagaaataattttttcttttaaaattaaattgtttattaaaatatatcgaggggatacaagtgcaggtttcttacatgcgtatactgtgtggcgctgaagtctgggcttttgatgtattcatcacttgaacagtgaccactgtacccagtaggtttttcaaccctcatcccctcccaccttttgtattccctaatatctattattccactatgtccatgtgtacatgtttagcccccatctgtgagaacatgcaagcttatatatatctgcaataaacatatgaatgaaggtatctttttttttttaataatttctttccctttgggtacatatccagtaatgggattgctggatcgaatgatagttctatttttagttcttacagaaatctccaaaaaggacaatctgaaacctgaaacggggcaacctgtttggaaaacagcatggagatttttttaatgaggttacttttttttttttttcttgttgagttgtttgagttccttgtagattctggatattagccctttgttggatgcatagcttgcaaattttttttccattctgtaagttgtctgtttacactgttgattgtttcttttgctgagaagaagctttttagtttaattaagttccatttatctatttttgtttatgttgcatttcattttgaagacatggtcataaattatttgcctaaacccatgtccagaagagtttttcccagtttttcttataggattttaatagtttcaggtcttacatttaaatcttcaatcaaccttgagttaatttttgcatatggtgaaaggtgtgagtccagttttcatccttctgcatatagctacccaattttcccagcaccatttattgaatagggtgtcctttctccaatgtatatctttgtcaactaggtcaaagatccattgcttataggtatgtggctttatttctggtttctctatcctgttccattaatctatgtgtgtatttttataccagtatgatgctgttttggttactatagctttgtggtataattgaaagtcaggtaatgtgatatgaggtaggaatgattctgttgcacactgtagagattttctgttccaaaggcttgggttgggggaaagggaggcagaagagcgattgaagctgaagggaaaggtgtgaaggaaccaagagccttgacaagatgaaggcagggggaagcatcttgcactgggagaacaagggagcagagtagaacccgacacccagctgctcccaaatatgcctccaccctacaaaacatcaacccattgcctgtgcacaacccaccagccgatggtcctacattccttatcagctaattcttagcagaaagccttttatatatcagggattgctcaaaaatagttcacatggattaattcttccaatgctcacaataaccctgtgaggcaggcaccattactatctcatttcacagaaaagtgtggcagggaagagttaatatcaaggccacagagactgacactcttctaagcaaggaggtgataacctgaccactgtatgtggggatgagcacgtaaggggagattttgtgctacccaggaagaaactgaacaggaaaaaaaaaaaaaggaaatttccctatgagttgggttagttgcagacatcactgtaaagtttagtaaaagccatcttgaaactgctgcatgtccagaggaaacaatcacaaaacgaagagcattttaaatattgttttaaaatgttttttaagacaggtgttaaaaattactatgattagattagaacttgcactggttccttgtagacagaaaataagtgtgtacttccaggaaaagagacgacaagaggagtaaagcaacaagttagattggggattaagtgggcttcagtttcctcacttataaaaaagagaagatagaattgaaacaaaaccaaaaacaacttctatctgaaacctacccccaactcccaagttacatgaaactaaaaagaaaagcccagactttggatggggagaatgtagctgaattcagttatttgctatactggtgaagccccacaatactttttttttcattttattttttgaatttttgaatattttatttcctctaaaaaaaaaaggtggggggatatgtgtgcagaacatgcaggtatacacgttctggtacataggtatatgtgtgccatggtggtttgctgcacctattgacctgtcctcgaagttccttcccctcaccctccaccctgcaacaggccctggtgtgtgttgttaccctgtgtccaggtgttctcaatgttcaactcccacctatgagtgggaacatgcagtgtttggttttctcttcctgtgttagtttgctgaggatgatggcttccagcttcatccatgtccctgcaaaggacacgatttcattcttttttatggctgcatagtattccatggtgtatacgtaccgcattttctttatccagtctatcactgataggtatttgggttggttccatgtctttgctattgtgaacagtgccgcaataaacatacgtgtacatatgtctttatagcagaatgatttatattcctttgggtatatacccagtaatgggattgctgggttaaatagtatttatggttctaggtccttgaggaatcaccatactgtcttccacaacggtcgaactaatttacattcctaccaccagtgtaaaagtgttcctatttctccatggcctggccagcatctattgtttcctgactttttaataattgccattctgactggcgtggcatggtatctcattgtggttttgatttgcatttctctggtgatcagtgatgttgagatttttttcatatgtttgttggctgtgaaaacttttgagaagtgtctgttcatatcctttgcccactttttgatgctgtttttttttcttgtaaatatgtttaagttccttgtaaattctgtatattagactttgtcagatgggtatactgcaaaaattttctcccattctctaggttgcctgtgcactctgatgatagtttcttttgctgtgcagaagctctttagtttaattagatcccatttgtcaatctggcttttgttgcaattgctaaaaccacatgattatctcaacagatgcagaaaaggcctttgataaaattcaacatcccctcatgttaaaaactctcaataaactagatatcgatggaacatatcttaaaataataagagctatttatgacaaacccacagccagcatcatattgaataggcaaaagctggaagcattccctttgacaaccagtacaagacaaggacgccccctctcaccactcctattcaacatagtattggaagttctggccagggcaatcaggcaagagaaagaaataaagggtattcaaatgggaagacaggaagtcaagttgtctctgtttgcagatgacatgattttatatttagaaaaccccattatctcagcccaaaaacttcttgaactgataagtaacttcagcaaagtctcaggatacaaaatcaatgtgcaaaaatcacaagaattcctttatactgacaacaggcaagcagagagacaaatcatgaatgaactcccattcacaatggctacaaagagaataaaatacctaggaacacagccaacaagggatgtgaaggacctcttcaaggggaactacaaatcactgctcagagaaataagataggacacaaacaaatggaaaaatattctaccctcatggataggaacaatcaatattgtgaaaatggccatacttcccaaagtaatttatagattcaatgctattcccataaaactgccattgacattcttcacagaattagaaaaaaactattttaaattatggaatcaaagaagaccctgtatagcctagacaatcctaagcaaaaggaacaaagttggagacatcatgctacctgacttcaaactatactacaagggtacagtaaccaaaacagcacggtactggtaccaaaatagacatacagactaatggagcagaacagagacctcagaaataacaccacacatctataaccatctgatcttcaacaaacctgacaaaaacaagcaatgggaaaaggatctcctattcagtaaatggtgctggaaaactggctcgacatatgcggaaaactgaaactggatcccttccttacacatcttatacaaaaattaattcgattgattaaagacttacttaaatttaaaacctcaaaccataaaaaccctagaagaaaatctaggcaataccattcaggacataggcatgggcaaagacttttaattattctcagtttattctcaatccagttttaagatgtctataagaaaagaggagggagtagtttttgtttctatcatgtgagatacactgtggttagaatgcggcatgctttataagtctgaggatcattataatggtatataaataacaatgagactagtgaataaatatcctggattttccactgatctggggaaaataagtaaatctgcaaagaagctataattccttggaaaacagatgtgaactaaaatatcattttttaaaaatggcattgtatatacaaatgctctgcaattacttttaagaaacaagttacaggactcaaatttcctatctccacagagcgctaagatattagtcctaggagagcgaaatgtcctggaagccaagaaaagcagagaaaataagaacataaattcaggaggtgaattaaggttgttcacatggagtaacattttataatgcttttatgtcaaaaataaatttgagattaatcattttcccacaaaaaatgttgtacaaactcccatttttaaattatgtcaaggtttaaaaatagaacactcatttttaggctatgttggtaattatgttaaagcactacagtacttcaggaaaataattaatacaatgaggtttcttggtactatgagctaccttggtatctataacctgcatattaaaatttaacaagtaagagcttataacaatcagagtttcaggacaagcaaattgactaattcttgtttccattataaacaaacattgaatttacaaggtggaatacagatgacgtattcaaatgagtttacaaagtacttaggattatgaatataaacctacattaataagaagactgaacacatcaggttactgctaaactctaattacttacaaattaatcaagtacaataaagaaaattatcatttgaaagacattcttgataatactactaagaactgtcaagcttcaattatccatgctaattcagaaagctggctaatcctaaacagtggataatttaacaattctttctattggcacagattatatttctgtgcgtgacaaatttaccttagcaatttgtttttcttagtttaatattaaaaacaagtcttgcttccttgctagatcagaatgcaaagccagccagaagattttttacaattttaaacgggttaattaccaagtatataatccacatatacagtatataaaatctaaatgctgtttaaaatattttagttaagctttcaaccacatttaataaatgcatgttaaggtatgtagattatgacaaaaatgataaaaaggatgcaaatttttttctatcactttgaaagtctgtcaaaatttaagtcatataaagtaccttgtgagttattatttcattttacagataaaactatagaaccttcaagaagtttcatgtggagtgactccattatggtaagtatattggtgtcctatatatatatttaaaatatctatcgcaaacatagatcttttgagttccctctttctcacttttctaacagaaaaatatagcatacacagggcatagtaaagaacatggatactggagcttgaatatctggattggaatctcgattcaccacttagagctgagtaaaaataggcaaattatttaacttcttagagcctcagtttcttcatctataagatggggttaatattagtacttatctcttagggttgttatgaagactaaattaaatgatacatgcaaagcagttggaacagaacctggcacatagtaaatactcaatgaatgttaggatttacatagcattaataagcacaattacttattttcaaatagataactcatagacaagagaggaaaaaaatctatttttctttaagagaagtgtcatatacatttctcaatttagcttataattatgttgattaaaacaataacaaaaatattctttgaaccattagagtaataattttcccctggtgtcaaggttaaagtaaggaagcagatatatcctcagtaaactcatcagagtatttcatcaagattttcacagttatatttagaaaatgaaaagctcataattgtaagattaaaatatgaaactttattataaaaagggcacagattttaaaagataagcagagagatttacatgagaaaagtgcagtatcacatctagtaatagtccaacatctactttaccttgtcattgttactctcccggtggaataaacagaaccatgtcacctcaggagttaatgctggccaagtgccaaaggccagcaatggcaagaaaggctgtggacagaggacctgggctatggctagaagagaatgccagagacggggaaaaactgacagggtaagagatgagacgatgaggacagaggtgctgggccagcagttgaaggagaggggagggagcaccataagtggctgtgtatgggggcgcagcagaaccatccacggtcagaccaacacagtgacaaacagccactcaagaagttcctaaagaactcaagcgttgacacaaaaggatgtgatgaacagcactcattcaggctcccactgtagcatcctgtggcctcgatgagtgggtgtggcacctggtcatgagaagtatctaataggtaggcccagggacataaagtaggaacaggaaggacagacctttcagctgtacttctttcctatatttaatggcacctgctttctaggcatttacttcattctgagagtggatgataatgatgatggtggtggccctggtggtggtggtaacgatgtatcttgacttacaatcatggtttccttcccattttgagatagacacaatgattcccgtttgagaatctgaagtaccaagacctagagaggttaaacaatttgcctaaatggcacaataagtaacaggaaagattgagttttgaaatcagtctctaaacctctaaaatccacagttttttttattataccatctactatttcccagtatacctcaccacagaaaagccaccatatcattgacctaaaagcctgaaacttctacttgtgaaacttaaaaagcatgaggacatcttttttttttaaaggaaacatgttcttatgctcttcacatctgaatagattaatagcaacaaattagaagtaaaatgattatacagacacaacatagttgaagacattaagtgttgtatcttcttgagtcacgattgcccccattaaaaaccactatgttttaaagaggactgtttatttagagatctggatggtaagctaaactttagaattaaggaattcagatttaaccctttgttacttgaatacgtttacatatatatttttaaaagcccttcctaattcaagaacgttaccccatttgcaatctctttgccagtctatgccatgacaagcctcatacacagtttccacttttatgtataccagtgactttctggatgccaataattcatacttccccaaaacagatacttgagaacatgaatcatcctagactattaaattaggagtgcactatcgatttaagaataactgacatgagctaatttgcagctattcctctggtatttggccctcagttggcactacaaagttagaatcctaaatattccaaggactggaattccataatctcttacaaatttccaatcttgtaagagattataggattgagggatggcatatttggcatcaatagaattcaaacgtctcaaatattttccaaattgaaaaagtgtccacttaaatactacacctggacaagaaattaataaatcaccaaggaaagcaaatatatcactttagaagcacatttgcaatttttaagttaaactaacagaaaccaaatttccttcctttgtgctgctaaacatttgacaaacctaaaagtatccttggtaaagtggctaataaactaacagaattaaatatcccttttgagtacaactgattacatgtatgcaagtacacactcagaactctatcaatttcaaactgctgtgaaaagtgctgaattccattctttcagggagatagaaaacatttataacagcaacagccctgcagtcacatctttttgtaactagctctaagaacgaaaaaaatctttatgacaataacaagaaaatgaattttcattttaaaaggcagtccctgtgccatcactggctgtcctgccacccagctcctctgaaggcattcagacccttcactggaatgtctcaaaaatcaatagcaatttattctctctttggaccccaagcaacaaaagtaaataatactgtcacctccagtctgcctgcagaacatggtcacaaaacagccttgccactaaaatacaaccttacgcagctctttatctatgctggcgctactgattgtattggctttcgtaggggacaaatacttcagcaaagccacacaaagaggtcaagctcttgtacctcagccagaaagaatgctgggacctgaattaaaaagaagacttgccaccacctaagcttcctgcttcaacaatgtgggttttatggaagaaaaacaagaatatttattttccaagattattaaaactaaggggaaaaatgtaagattaaatataccatatttacaattttttcctatagaatttaagaaaatcatcagatcactgaagcaattggttgaaccataatattttgcagctaaaatctataggtaggcaatttttatactgtctgataaaagtattaatccataagcaaactacgacttaagaattaaagttctactttgataatgtttaaccaagtaggtgatatcaataccattcgattgttgaagacattatatacactctggaatatataaaatggcattttgaagcaacagaaggaatactaggaataaccaagtataatcttatctatttagagaaaaaaggaaatcaagctctatatgtaacaccagaaaaccagttaatggaagaagcaggactacaatcccgtctaacattcttttcactatactgcttattgatgaaaaattacttataggcatactaaagaagagtcaggccaggcgtggtggctcatgcctgtaatcccagcactttgggaggccgaggcgggtggatcacaaggtcaggagatcgagaccatcctggccaacatggtgaaacctcgtctctactgaaaatacaaaaattagctgggtgtggtggcgcgcgcctgtagtcccagctactcacgaggctgaggcagaagaatggcttgaacccggaaggcggaggatgcagtgagccgagattgcgccactgcactccaggctggcaatagagcgagactctgtctcaaaaaaaaaaaaaaaaaagagtcaaagtcattttgatgacaataagccatcatccctcagggctacaaattactccttaagagaaaaagcaagtactttgaaacatttgtgcagtaatcaaaaattccgaaatcatagaagaatttaccagtcaatcataccagaagtatttactgaatatctgctgtgtacttctcactagtaggaaatacgaaaaatatacatacatgtttaggaaatattaaaatattgaatataaaactattaaataaaataaaatattaaatataaaaacaaaaatattaaaatattaaaaataatcagatgtcaaattgtacagtcaaagaataaatggaaatcaggcaggtgctgagaggaggagagaggggaggtaggttggatgagggacagggaggaagacaggtgacggaggcagacaccagggctgcagactgtgagtgctgggaggtgctgcggggaggatgggcctggcagagcagtggtgcccatgaagtaaagtgaagacagagagtggggccagacactggaagctccagaaatcaggcagaaggacttgaacttaatgtggtagagactccagataatatagaattaaccattttaacttggcaacatcactcctattgttttttggctcactcctagctcaaaaaaacaaaaaatacactaaagatgttgtcttattggtcagaaaaatatgacttaaaaatataacaattttttgaaccaaaaaggtgcttcctggaaatttcatttaaataacaaaaaacataccattgtgaaaaaacttcactcaaaacttacagttttctgataaaattaatatcattaagctaagggagaaaacaaatctctgaatccctcatttttattcggtaacattaaccactttggcaaaaaaaataaatgaacactaggattgggaattttgaaaaatcatgtttaacttttgtactttaaagaagatacaatgaagttgatatactctatcttctataaaactatgaggcatctaaggttaatcattaaaactgattaaatattatatttaaaaacaaatactcatttatgttttttcaaattttagaaagtttgtaaattctgtagtaaaccaaaattcttttctctttattttatgcattcattatagaaagttttgggggaaaagtgtgtgtgtgtgtgtgtgtgtgtgtgtgtgtgtatgcatgtgtatagatatacagacacacatgaataatcatgtgaaaacttatctgccagaggtctactctaatatttgttacaggcctctttctgattttaaaacaatctacagcagagatataaatattttacttatcactgtcaatacatatcaaatgtcttgaaatgactatgtcaaggtaacacagtaactacacttataagaatatatcttacagaaaagattgtggatgtggacagtggtctagcaacaggaatgttcaatgaaatattgctggaaagatgaaaatgggaaacaagtttaatagccaagagcaaagcattcaatatgtaagttataaacatattcatactttttcatttttatacatattaaatatagtcactgcccatccatttatttctcctattttcctaattttgaaaaagagttcccagaatatttgcaaattaatctgtaaacactgaatgatagtgcctgccctgaagcccacatgaggtgcttcgaggcagaaacggtgtgtagctggtgcccagaacaatgcccagaacagcacctgccacagaggacacggtcaacaagtacttaacggagtgaaaataaaaagttaactaaggatttgtaacttacactcactcactttgaaaaaaaacagaagcagtttacaacaaagtatgataaaatgtagttttcttttttaaaacagggtctggcttgcaatggcaggatcttggctcactgcaacctccacttcctgggctcacaccgtgctcccacttcagcctcccaagtagttggaactacaggcgcacaccatcatgcctagctaatttttgtattttttgtagagacagagtttcaccatgttgcccaggctgatctccaactcctgagttcaagcgatccacccacctcggcctcctaaagtgctgggattacaggcgtgagccaacacgcccagcctagattttttttaaatgtaaatcaaagtaagagaaaaaaccaaaacatccaaaccatacagaggaagatggaaaataacagaatcaggaacctgagctcatgccaacactcaatcatacgttcaaactttctgtcaagaaaggctacagcaggactgcaagtgtggcggaaggcggcagtgtttaaaatgtaaaacttcagatcaagccagcaggagtcaaagcctgatttcaccagttgttagcactgtaggactctggagaaatcaatgactttttctgggcctccttttcctcccatacagaatggagctcttatgagagcatcaccatagggttctgagattgacaccagccaatccgtgcacagtgctagttgcatggtgtcagaacacattaagagctcaatgtatgccaaatctgttatattcatcattacagctttgactgtatgcaaaagataccattcagttcttccaagctgcatttatttcatagattcaatatttattgagactaaatatttattttaaaacttggttggatgaagccccaccaatgtcttcaaaagcctaacatggaaatggaagaacagaaataccaacatataacagtgactcaggtgacatgcatagaatagagatgtactcaatgttccctgaagtaagaggaggaaatgatggattactgaggggtacggctgtggggcaatatcacattaaaagtgatgtaggaactaggacatgaaagaggagtcagagtacaaccaagtagggaataatggtattggaaagtcattccaggcagattggacaacataactaaggaaactgaggcatgggaggacacgagaagctgatggtggttgaacactgtgtgataggatgctcgtggaactgtgacagaaaacaaaatggcaacattctgttggggtcaatttttgaaggccctgttgtgcaatttggactttaacaagtaagcaaaggagagccagtttgggctgataatgacatcagtgttttagatactaggattatcatggaagacagattggatttagagagtgggaagaaagaatagaggctaaaacatcaatactccaggcaacaactaatgctaggtaataaataatacagactggaaacaagacaagacagtcgagttggaaagaaggaaacagatgccagcaatattgctgagggacagtcagaagaattagcacacaggaaagtcaaaaacgatttcatggttttgaccttatatggctagggcagtgacaaaattaattaaggatggtaacatagaggaagcacattttggggcggcagagaaagaagactttattttatttatttatttatttatttatttatttatttatgaaacggagtctggctctgttgcccggctggagtgcagtggcgcgatcttggctcactgcaacctctgcctcccaggttcaagcgaattctcctgcctcagcctccagagtagctgggattacaggcacgcaccaccacacgcctggctaatttttgtatttttagtagagatagggtttcacaacgttggccagaatggtctcgatctcttgacctcatgatcccccccgcctcggcctcccaaagtgccgggattacaggcataaaccaccacacccagcccatttttaaatagattgaatttgaggtagctctggaaaacaaggaggtgatgatattcaacagaaagatggaactaagacacagaagctcagaacgtggattgagaggtcatctgtgtaatagatgacaggcaaatttacaacaccagggaaaatttcaaggggacagcatttgaagtcagaaggaaaccaaagtaatgacacttactctatcactaaaaagtatgatatctaaaataaccagtatgcaggacttaaaacaactacaacctacactaaaagatagagagaaacactttaataaatgtagagagatactatgtgtctggatgggaagaataatttgtgtagtcatcaattctctaattaatctgtagatttaataaaattctaataaaaaactgtaatatacttttgggaagcttaatgaaattattctaaagtcatctggaaagagcatctgagaataactatttttaaaagagtaatatgaaaggcaaaactgacctagcagatattaaaacatattgtaaaaattcaataatggaatactgacttatacacaaaaagattactaggttagaaagtccagaaatagacaaaagtatgtgtaattattcaaagcataaaaacctgcaatttcaaatcagcaagaaaaaagataactttaatcttttagagaagcaacatgatgagaaagctttttcttctgagttgtgttaaggatgatggaggtcgtctaagcttttcatacttagagaggaagacactagtaacagaaatacaaaagaaagtgttcagttatcacaaagtcagaagtaaggaagttgtggattctagtgaatgtttactactggagggaatcatggaagaaaccaccaaccataatgaaatgatgccttcagaaaggaaagcgccaagaaggatgacttgacaacaatgctagagacagctcttaagaacagatgttttgatgagtttccatacccaatttattggaaatatcaaaaaaaaaatagcagaggtgaaaaaaataaaactttattgtcagagattgggcttgccaaatttaagatttctgagttgtcagttcagagaaatggcataataaatcagactgcagcagcagaaatgtctggccaggatttgggcaggtcaataacatagatttctgaagttgccaaaagaagtgcccaagaattaaggcagatggggacagggtattgaatgatagcttcctccattactgtggaggcatgacctgtggtaaacagagggagagaaaagaaagaaagagatttagctaaatattttgagcttcaactaaggtaaaaagttactgacaacagaatgtgaggctgagatatgtttttatttttctctccacagtgcctaacacacagtacacatattgtaaaagattatctaagaatggctggacgcggtggctcacgcctgtcatcccagcactttgggaggcaaggcaggtagatcattgaggccaggagtttgtgagcagcctggccaacatggtgaaaccccatctctactaaaaatacaaaagttagctgggcatggtggtgggtgcctgtaatcccagctacttgggaggctgaggcagaagaatcgcttgaacccgggaggcagaggtagcagtgggcagagacggtgcaactgcactccagcctggccaagagaggagacaacatctcaatcaaaaaaaaaaaaaaaaaaaatgacctaagaatcaatgcatgtggtaggaaatgctggaaaaaaaacactggagaacttaaagacaaccccaaattctgatcacagggcataggagataaagcagaatgagtagcagccacatgaaggcatcaaggtaagcagcatcaccaaaagaaagcctggctcagccaatgacgacaggtaaaaaggattaataaaaagacagacgggcaagggcagttcaaggaccataacagctgagctagtgatggaagacttccttttgcacctttcgaataaaattatttcattatctccacaaagattcacttccaggtacttggttattctggcctcccaccctctatatccattagtccccaccgtgaaaagcactgtggagaaaaaaaaaaaaaaaaaaaaaacactctttgcacctgaaattatcatatttaatagggaaaaaaatggaaaatattttccaactgttgtttatttctgaatttcagattttgttctcaattatactggcctggaactctgtcagaggtgaatatactcagacccatatgactgatttacactagaaagctagtctgtcgattgctagtatgtaatgcaattgtcaagctgacccacgtttgtataatacctgcatcaactcaggaggtgttggctagcttgcaaattttctttgaaaaagcgcttacctaggcaaaggacaacgtattttttgaaagctctattgaggtctgacacacaataaatcacatatatttaatgtgtacaatttgacatatttggacatatacatatacccataaaaccattacaacaatcgagataatgagtacatcacccccagtagattcttcctcccactttgtaatctcttccttctgcctctccctgacatcctcccaccctccactcacccatttgaattacagattagtttgcattttctggaatttatacaagtcaaatcacacagtttatattcttttgtctggtttctttccttccacacaatgattttgaaaatcatttcatgctgttgcatgtatcaataattcccttttattgttaaatagtattccattgtatagtatacaccaatttgtataaccattcacctgttgatggttattggagttattttcagtctttgtctattacaaataaagctgctatggatacttgtatgtgagtctttgcatgaacatatgttttcatttctttggggtaaatgtctaaaagtagaatggctatgtcataaggcagctgtatatttcactatataagacactgccatactttttcccaaagtggtttctccattttccattcccatctgtcatgtatgagatttccagttactctgtatcctcacccgtacttggcatctttcaaatttcagaattctaataggtgtataatagcatttcattgtggcttcaacttacatttccccaatgactaataatgttgggggtatctttgcatgtgtttacttgtcatctgtatactatctttggggaagtaactgttcagatctattgtctatgttttattgggttgttttagtatttattgagttttgagagttctttaaatagtctaaatataactccttttatcagatatgtaatttgcaaatatgtttctccaagtcctgacttgtcttttcattcttttatcaatgtggttttttactcgtttgttttttgagatggagtctctctccgtcacccaggctagaatgcagtggtgcgatcttggctcactgcaacctctgcctcctaaattcaagcaattctcctgcctcagcctcctgagtagctgggattagaggtgcccagcaccatgctcagttaaatttttgtatttttagtagagacagggtttcaccacgttggccaggctggtcttgaactcctgacctcaggtgacctgcctgccttggcctcccaaagtgcgggattacagacgtgagccactgtgcctggcctttatttatttatttatttatttatttatttatttatgaatgaatgagacagtttcgccctgttgcccaggctggagtgcaatggtgcaatctcgcctcactgcaacctccacctcccgggttcaagtgattctcctgcctcagcctcccgagcagctgggattacaggcaccctccaatgtgcctggataatttttttctgtacttttagtagagatgggatttcaccatattggccaggctggtcttggactcctgacctcaagtgatccgcccacctcggcctcccaaaatgctagaattacaggtgtgagccaatgcacacagcaaggtgttttgaagagccgaatttcttagtgttgatgaaatccagtttataaattgttttatttatgaatcctgctcttggtattatatctaagaaatctttgactatttcaaggtcatgaagattgtcatttggaagtcttatagttttaacatttaagtctattgtttgaaaaaggacattttttctaaatatgtcttaactgacatattactgacagaagtaagtaaccacacctattaatgaagttgcagcatcagcatctcaactattctgggagacaatgtaggccaaatgttccctgatattatgttgataataaccccttctcaaaagggcgaatactttacttcagtatcaataccaaggaaggaaaaactgtggtgtgagagttctgctccctgggtgccctctctattttgcctctgacccatgaaactttaaaaatgaagattatgaggaagaacaggccagtgaggtcagagtcatgggttaaagccttagggtcagcagtctgaggatcttcattttaaattttcccctactgtaactcccttgctcattgtttgggtatatttcctattcaatgttaatgttaaaatatcactgccatcttgttttttctctttttgtttctgatcctatttcctttcattaaaatgttattttctgttttcccaaaattattaaatacatataacacattttcttttcttcctcaaatattattaagtatagatacatatacacttaatatatacttaattaagcatatatatactaaataatatttgaggaagaaaagaaatatatgtttatatgtactatgtacatgtatgtgtgtatatacagatacatatatacttaatatatacttaattaagcatatatacttaatatttgaggaagaaaatacagatatatttatatgtactgtatgtgtgtgtatatatatatttaatatttgagaaacaaattaaaaaacatatatactatatatatgtacacacatacaggtcatgagatcaagattattgtcatagaatccaaatctagctagaaaacacaaaatttaattcccactgcaattttaaccccacagatgagccttgataaagtaatgagagagcaataagtagcttatcttttagaggtaccagatctgtttctagtcctaaggcatttcagtagaatgcttatttcaataaactcacttaatgcaaaagataagatcataaaggcttgtaaatcaattttttttaaaaactaaaacataaattcactagtggagctcactatttaggtaataactctattgaaaacacttttatagagtaaataatcactccttctcataaattcaggtttacatctgtaggctttctttaaagcaatcttcagtgaatcattttctgaccactgtgtccaaaataattttttaacactgcacaaaaggagatatttaatataaactgttttccgaattgtccttattattgttttcacagcagccacaatgtgattaatattggaaaaggcaccattatattcaagcctcactttcaagtagataatattttaaaacataagacacaaataaaacaaagttattgcaaaaagttggcaaaatatagaaaatctctcgtttggcctctcactttcacacgtgtttttgaaaaagattccaggaagactcctctgtgctcaacagcacagaacagcacatgcactctgtttccttttcttcatgaaaaatcgtaagaatgtggaagaaaaatagtttattagcaaaaaatgcagaaatgtaccaaagaaaaattcttttgtaggacttctaactctataagttattaaaatagatacaactcaggaaaaatttatcatgaaatcaaatatgacagaaattaaagaaaacttaaaggtgtgttggatgcctgaagttggtgttgggtgatgaaattgaggcaggagaatagagtctggaggcagggaacctaaagctgtttcacactgacttcctaaaactaaattgaaaggaaaaccctaactttccacacctaagtaacaaaaggaccagagactactccctttgcaaacccccaccttgtctgcatggtagatgggaaatttaaagttacataggagtgtgacctttgtaacttttcccttcagcccctgattactgtctacagccaatcaaaatgattgtgggccaagccttcatttgcatagaagtgcaactttgaaactttagcctctgattgattgcataaagcataaagcaatcaatcagatgtttgcacaggtgtgtgacctttgtaacttcatttcagcctctgaatggtcgttttccaaggtgaacaccaagtggccaatgggaaacctctagggggtatttggacccaagaatattctctatttgggtccaaatagacccaactcccacccgctcccaccctgtggagtgtaattttgttttcaataaatctctgcttttgttgcttcattctttcctttctttgtttgtgcattttgtccaattctttgctcaaaatgccaagaacctggacactcgccactggtaacaaaatgaatatttttatatgtgacagtattttagaaaataatgtgactatacatattcatatacatatacatagccttaaaatgttcataccctttgactcagtaaattttatttatctgaatctaccagagattttcaaaaacaatcctaaatttggaagaatttcagccatacaagtgcatatagtagtgctgtgttggattgcagcagtgaaaacatcccagctatgcaaccacagagaactggttaagaagatatggtattattatatatcccaaaggaatataaattgtcctaccataaagacacaggcactcataggttcatcgtagcacccttcacaatagcaaagacatggaatcaacctagatgcccatcaatggtagcctggataaagaaaatgtggcacatactatggaatattatgcagccataaaaaagaatgaaatcatgtcctttgaagcaacatgcatgcagctggaggccattatgttaagcaaattagtgcaaaaacagaaaaccaaataccacatgttttcacttataagaggaagctaaacattgaatacacatagacacaaagaggggaacaacaggtactggggcctacttgagggtggagagtgggaggactgtcaggactgaaaaactacttatcaggtactatgtccactacctgggtcatgaaattatttgtatatcagatcaacaggcaatcatgagtgcaccaaaccaacatgcaatttacccatgtaacaaactggcacatgtacaccttgaacctaaaataaaagttttaaaaattaaaaaagaagaaaaaaaagaacatatggtagattctattaatttggtagaccattatgtaggtaataagggtacatttgcaaacagaagaatcccaaaatgaaattttcagatacagaactatacaaataaggtatacagcttatattaaaaatgattcatagaattaaaatgactgtgagaatattcagtatcactaaaaattcaaacagtagttttattggagcaacgacattacaataattgttatttttactttcttgtattttgcaaatgttatttaatgaacacgcattattatgaatgcaaaacagctgctatttttaataagagagccaagaaatacaaatatgttcatgcttcttcaacagtgaagcggggaggactttatcttattctaggcctatgctgtccaaaagagtaatcactaaccacagacggctatttaaagtaattaaaattcaaactttagttcctcagtcatactaactacattttaagaggtcaattgccatagtctactagtatcagacagcagagagaacattttcatcgtcagaaaattctactgtgaacgagctgttctagataattggcatgggatcatagaagataacctacaaggaaaggataattcataagatgcaagactctgtagttagtctacactaaaccagcaaccttagtctattaagaaagcctgttctacaagatggactatgctatataaataagtgactcacagatcattagcaaagtaactataagtcattaggtttttggttagtttcctggggatgttattttggtatctgataaattcatacaaaaatcacgtctgttggaagtttatgaatgtaaaaaaactataattactctaagatggaacaattcctccaacatgcagccttcctacagagtaaacaaatttgtctttgtcttataataatcggttgtcttgaggaggcagaaacaggaaacaaaaagacaactttggaaataatactttttaaaacttttttcttttaaaaatttctgggaaaaaaaggcaagaaagaagaaagaaattcatttgaaaaactagctcttcaaaagcagtaccaaaatcacttaggtggataaatgtttaagagtgaaaaaacgtacacctttctttatttgagaaagtagaatagtatgaagaaataagaatgcaattcaccaagccattattaatgaagggcttatctactagagtattttgtgcagttggtattccattacatataatacatttcccattagaatgtttatttaattttcttgatttaccctcatcattgtacgaagatgttccaatccattttaaattaataggctgtcttcatttcaaacatgcaggctggattttactgacataatgtgaacactacaaaaagctgtttatctttgttgaagtatgccaagatcctctgattttttttttccagtgttttctacccttgagatttaaaactgaactcttcagccaggaaaatcaaggcagcagaaagtgtaactattaagatgtaagttgcacttaaaagtgtttcaatgccccatagctttccatacagttcaaaaattatgtctagtttttaagattattaaatgttacttagaggtgggaattttatcaccacagcaattaatatcagtggaaaaccctaatacagcataagttgaatgacaacctttacaatgtatccatttagagagggtgggaaactcaggaaaacaagctgagtatttggagtcagaagttttaggctgattgtcaatgttgctgattctcgaaacttctgtttccttatctacaaaatagagacactgagaatgcataatacatggggttactgttgtcttcatggtacaagttaggacacaaggagcaggttacttattttaaatctgttcactgttagtgaggtaaattattcaaaacaaaaccagaaaaaatgattatgattaaaaaacaaatcccagcaggccagcctccctttaaatatatttaataatatgaccaaacagatctgtaaaatatacaaataagggaataagtattcatttaactaaaaggtgttgttaaatagaacttcatcggacctttaaaatgtaacttaaaagtataatttaagcctagtgtttttcataaacatgtttacggtgtaaaaaagaaaatttgtaatttatatatattgcatctactgtattaagtctgcagcaggactggacatgttcctaaccatgtacaaaccagtcacactgcttaccagctatagaccttgggcaaattactttacacctctgagtattaatgctctaatctttaagatgttgatgatgaaacctacttcatagtgctgctgtgatgactaaattatgccacgaagcatgttgcacagatgtgtactgcaataaatcaatgtacgtttgcagtcatctttacagcacagctggtcatgaagactctcctgagtacatttttgactagagatatactgtgttttaaaacttctagttttaataaatttaaccattgagtagaactgtgctacttcttcaatattcagaaaagtatatatttttcatacaaaagtaaatatatatatataactattaatttcacattagaaatatgaaaagcactccaattcctggaaaatgtcgtagtacaaaggggaaaaattaagatagatgaaaaccagaagtattcctctacacctttaccaccgacattaaaaagtgaaaaatcaattcccttttcctctggtataagcaggtaacaaatggtaaacagtttagccagaaagaagaaaagccaaggaaatccacttactaaaagttaaattcagtgactaaaattatctttcgtatgctcaccactaccaaaatctatatttctagctatgttctttcctgagatccagatatatggacaacttccaagaatcaaactcaacatttctcaaacagagctgagtatttttggccagcagaccctcccctgccataatttgccttccctgtttttccctctcagtggatgtcaagtgtgaaggtcagtctgcgtgtgtctctcttcgcccatcattaacgtgtgcattcaatattataaacacaggaacctctgctttgcatgcaatagagggtaagcaagcctgtttatagcgaacgtccattctgaagggagagcgcacaaattattaaacagataggactcctttcaagccttttaagcactgtctgggttagggatgtggtggctacagcaacataaaaaaaagttaattttaaaatattaaacataatacaaaatggtgacatgatttttctctaaaatataggaagtgatcaatcaaatgaaaaactatattttaagtaaaacttcaccataaatgtcatgatttagccacagctgaaaacttaaagggtcagattcttccagctgaccctatggtgcccagctggctgaacattctgagaataatccagtgcagtggaaacactggacatttaataaatgataactcctgaggaagaacaaggaagtcatgtccacaccagaggtgggtggtgtaacggctgattttggaggagaagtttttgttttgttttgtttttcttttgtggggtgggggtttgttttgctttggcttgagacaaggtaggaaaacccatttggaaggctggaaatttgatatttgatataagagtctgtctggctagaaaataagttcttccagacatcaaaaaggaactaataaataatcagaataaacaaatattggccatgatatatatttaaaaggtagcctagctaggcatgatggctcgtgcctgtaatcctaccactttgggaagtcaagctgggtaaatcgcttgcacccaggagttcaagaccaacctggaaaacaggtatgtggagaaggactaacatatactcctgagaacatctcagaatacgcagagcatgtttttgttaactttttcaaagatcagctggcactccgtagatatatggctttatttctgggttctctattctgtttcattgatctatgtatctatttttatacaagtaccctgttgttttagttactgtagtcttacagtatagttcgaagtcaggaaatgtgatgcctgcagctttgtttttggttgttgttgttttgttttgcttaggctttgcttttttattttttatttttttggttccatatgaattttaggactgttttttctaattctgtgaaaaatgatgttggtattttgataggaattgcattgaatctgtacactgctttcggcaggatggtcgttttaacaatattaattcttctgatctatgattagagttaaaagagcctctttttctttttttttttttttgagacagagtttcactctgtcgtccaggctagagtgcagaggcacgatctcagctcactgcaagctctgcctcctgggttcacgccattctcctgcctcagcctcccgagtagctgggactacaggtgctcaccaccacacccggctaatttttgtatttttagtggagacggggtttcaccatgttagccaggatggtctcgatctcctgacctcgtgatccacccgccttggcctcccaaagtgctgggattaccgtcgtaagccaccgtgactggccacaaaagagtcttttatggagaaatagagaatggaataaagccagataaattcaatttactgctcataaatggccatgcttcttcttaacatggtccccttactgcagaggctatatatctaaaaatgagagaaaagcaatcacactgttgcttatgagcaatctacatgaaatacaaaaattccccttctgaaaaattataacaatttgttattgaagatgtgtatgtaaattttcccacctgtgttacttttttatacaagccaaacctagcaggaatctctaattatcataccatgaggatggcttaacaagggtgttgccagcccacaaatgcaatttgattctcagcatgaaggcaagactggcaatttacaaactccagcaacaagtaactatgaatattaagatcttaatttacacaatggagaactcattgctcttagaataaaaaaaggaacattttgaggatcctgttgctggatgtggagtaaaaaaaattatggtaatgattctgacaattgttgaagcacatacatacctgaatatcagggtactttttagaattattctgctcacaatggggaaatattttacttaaataagcagcctgaatttgaaatcaagtcataaggtaaatgtctcaattacaaatggtactgctttatatatggataaatctcatagacataacactgactgaaaaaaacagacataaaacataatgcatgattccatctatataacgttcaagaacagacaaaaataatctacagtgatagatgtcagatggtggtgactttcagtgaggatattgatgggagggtgcctgagggagtcttcatgacttagaaatattctacatattcatctagatggtgagaacatgggtgtatacatatggaatattatttaacctctacatgtaagatttgtacagttcaatatttgtgtgatatactgcaataaaaatttaaaaataggtcaattgtattagataactaacaaaattgaaaaacagatcaatagtactagataataaatatacaatagtctttatctttcctaaaacaaaatttaactgttactttagtgagtaccaagagtgcacacattcagaaggttttggaacccatctccttgtgtagcacagcattacatattttacatttcaacgtggctacaactcctaatcctcctgtcaagaatcccacatgagccaggctattgataaaacaattgcttctccagtaaagagttttatttgctctctcattgcctatcagcttaatacataggagaatatacttgaaaaggatcaagttctataaacaggactaaatgattatggagcaggcatctttataattgtgtttttacttttttccccccagttgtttctcaaggaatacagcagaaattgaaccataaagcttagcttgacagaaaggcattagcctaccatgctaaaccaaagataggagagacagttatttatgaagaaacactgttccctattatccttctgagattctaaaaaagggctaaatattgatgcatttcaaagtcaccttttcccccacttcttgtattaacaagcaggagtatgttttagatgctcctaatttgtcaagatcaggtgaacagaactgtcgtacagagcacactgctctcattcctacaagggctctgcaaccctgtgggttattaataattcatcggtctttcttagttcacaacaggggcattactcagagggcatcattcttactgaaagaagttaacagcgatgggcagataaacaatgcacaagtcaaagaagaagaagcctcttatgaatttgtgaacactgaagatctgttaaagagctccaactactataggaaaaaaaaaactgctaggtattctttacctaggcttctattgcctgttaggctaaattcagccatctttagaattatatcagttgtattaacacagaaattccttgaaaatcatttaactcttttgtgtgttaacacaggttatactactgggtacgattatgttgtctttattgaattagtttctccaaactaatctttttggcaggaaaatgatgtctacttttgggttccaacagtatttatttatcaaggaaatacatgaagcatcctaatgtcttaatgattgaaaacaagtctccaggaaaaggaacaccatcctttatggtcctcctcaatacacgtagaccctctgggtgaaatttaacacaggtattccaaaaaatttaaataacaggggcaacaggctcagaagcctaaaggcatgaatcacgcaagagtgtaaaacagtagagcgaggcagagtctgcagcctgtgactgcatgccctgcttaaagaaacttcaaaaacaaaccaaaaaccaaaaccaaatactgctaggccaaacatgcctatgtggggtgaccaatttcagacccatagcataaatcagaagtctttattctgaatatatgaggactcagaataggatgtattatgtcctctaaataaaagatattcatgtgggttaaataagagcattgatttattttcttgaagatatattgttattagaatgtactccattatttagaatgtactccattatttagaatgtactcgaatacaaattaagcctctgatttctgaatatcagtaacgagtaacctcgctttagctaaaaacagtaacataaaatttactgagcacttactaggtgccaagtactattctaagcactctgcatgcataaacagacttgaaattctcacaccgattctatggagaaaccaagcaggcacagaatgagaaagcaatctgcccacaaaaacacagctaatgaggctgctgttcaaactcaagcaacctgctttcagagtctctgtttccttgtttactgctcgcttcctcttagttaagagcacagctcatttactccacatgaatgcatcaagggaaagcggtagctttcactcattagcaagactgatataaaataaatagaaactcaccaccaaaatcactacatatactatacctcctaccttagctacaaagcagaggagtttcagggaccaagaaacaaaaggcttggagacaatgagtacagttcctgataacagtagataataaatatcactaggctgagaaagagttaagaggtcaaaaagaggaaaagatgattctataacaacatgccattttcctctcgtactagaaatggacatcttcagagtctttgcttcctttaagatactaactaggtcagatcagatgttcctctttttttcttttactaatggaatgccctaagacagaataaatatagaaattaaaggatctttgaaaaacccttgggtttttctttactgataatttcaaattttaaatgctacagattctataattacagtgacctcactcttggcactgaatgttatgccttcatgctacagtaaatacctttggttatgaaggatatgctgtcctaaaaaatggaatctttactagtaatgttgcaattttttatctgaggtgtttcccattcatctttttcaaaatagaatttcaccagaattaaagttaacatattatttattcatcatatctgataagcatccgatgatgataaggaatttttttcataaatacataaaaatttctttcaacaaatgcccctactatatctaaatatatagttggaaatgtaaagcaaaagcatttcaattagataattataaaagtaaacacattttttcaatttatgcacacttaaaacataaaatgttttagaacaaaatatttcaactaatttgttttaattagttaaaaatacattacaccatctcatagtagagacagctacataacatgctacataatggattagtgtcagaaaatgccaactttttgcataatttcaagaatatattccaaaaacacccccacttaccatcaagatttcaaaataataatagtcaatatttatatgtacctcccattctgtgtcccaccaattatctcattggatatccaaagaaaaaaaaggttctacatctcaagaagtttgaataacccttaaaggatcaaaatgtagtttattttatgaaaggctctgagaattcttgctttgaaaaaattaactttcggtgaaatatattgttttccagttaatgacatacttctcatactcatgcacgattctaatactttcataaacaaatacttagaaaaaagttccatcaaataaccagtgagaaataaattcaacctacatcactagagtcaacatgattcattggttagaaagggaaaggaagacatctctctcttactgaagcagcagtagcagcctggggtaaatctgtcacgcaaatacgttgggctatttcaatgttactcttgttagatcttgcttttatcaggctttcatgtaaataggtagtaaaattttcaaaaaggccatgtgtccatatgcacagattaaaaaaaaaaatcttttgttgtgcagaagctctttagtttaattagatcccatttgtcaattttgtcttttgttgccattgcttttggtgttttggacatgaagtccttgcccatgcctatgcctgcacaatgtgcacatgtaccctaaaacttaaagtataataaaaaaaaaagattagaaaattaaaaaaaaaaaaaatcatggttgtccagacagttgaactgggatttcatttccctgtgtatcaagagacttgtgcagtaaagggttaacttagcagtcttgaggttttcaaaccacacacattctaaagaaaagaaaagattggctcttgacaagctcctgggatataacctctaagtgcttggagtatcctgcctagtaagagtttgcttttctacctggggccttgggccacactagacagttttatgctaacaatgtgatttatggcaaacacccgttctagttcacccagggccctaggtcacactgtatcagaagtttgactacaggaggggctgcagactgagtaactaaagttacccacgtaggtgttccacacctacaagacagaccccccccaacaaaatccttgaccaccaaggctcagtgaccctccgggttgacaatactccatgtgtgctatcacacatcattgctgggagaattaggaactgtccacacaaatccaccaggacaggacaaccagaaactcattcctggtctctccctgactctgttctatgtcccttttacctttgttgatttgaatctgtatcattttgctatattaagccataactgtgtgtataatagctttttataatagattttatgatttctatgagtcctttcagcaaatcactgaacccgagagacaaactagattcttcccattggtatctaggattcaaccagccttattatctgactccttggtcatgaccagtctctgttcagacacctaatatctatcgaaccccttaagttaaatcagcctccagatttcagcagaaataaatgcacagaaaaaataagcccatataatttgctgtagaatgtaaaaagcaacttttgatatttaggccaattacagtaataaacattaaataaaagagactgaccaactgcaaactggactattttcaaacttgttgccaatgactatcctctaggtaagagatgaaggtgcctcacaaattcaactgtataagatgtatgtgcccagcagggtcgtgcctgaagtagccatcctgcctttctaacctatcttgtcccatctatcacctcacaacattggccactaatgctgcatcctcagtagagatgggatcgtgacctacccaaacattcattataaaggtgtaagaatcaaagaagcatgttgtcagctctgcttttggcaataaaggaaaggtttttctcaggttttcctcttcacatggttttgggctgacagtgagcagtgagcaagctgtacttaagagttgtccctaacagatgtgagggcggggacagcattgaatacaatcaccatctctgatggccccctctctaaatgcattaaaggaactcaaactggaaaaggagaattatccagccattaaatttcattctttatgagacaccaatagctacctttttttgctttcaagaaacttgggttatgggcacaaagatccttcaaaatattcaaattatccatcttgaatctcagacaatttttgtgcataataaaagttcaattgaagcctcttttaaagagtcacttgaagaggtacatagtgactaaaataatcattcaaacaggagataaacaggaataagtgaagctaattcaacctgcacatgcatatttaacatgatacacatatgttacaaagcatactataaatatctctgtgcctattgaccttgtgcagctctaggaataaatgctggaggaatttggtacttaaaatgttgaagaggtcaggcacggtggctcatgcctgtaatcccaacactttgggaggccgaggcgggcagatcatgaggtcaggagatcgagatcatcctggctaacacggtgaaaccccgtatctactaaaaatacaaaaaattagccaggcatggtggcgggcacctgtagtcccagctattcgggaggctgaggcaggagaatggtgtgaatctgggaggcggagcttgcagtgagccgagatcgtgccactgcactccagcctgggcaacagtgagacaaaaaaaaaaaaaaaaaaaaagaagaaatatggagtgctggtagacatttctgtcaatagcagcaatcagtagcttaacctctattgcttctctcattctacatggcagagatagcagtgataactgtggcaatccagcagaatgcgaggccttcagaagcagagctaaatatgaggagtagcacacacagtatgtgtctttatggcagctcttaggaaatctgtccatttgcacaggtgctcctagaggcaaatgagcagacataccttgaaccatagtgactctcttaaggttattcaaaattaaactgtgtcactcccaaagagacatcacaatcctggaagaattcagtcacctgtgactaacctgacaacaattaacatacttgaaaattgtataaaactcaaattaaattttaatctttcatacttaagaaagaatcagtaactgataaagaactgtttaactcaatttgaatgtgatttcatgaaaggatacattttttaaagttattcatctggatcacatattcaacagttagagttttccaaaataattccaaagcaggtttcatgctgacatttttaaatcgtaaaagctttagcacagtaggcattgtccttgcctggatgttctgtgtcggatctacattcgtgtttatactgtgctgctgaacaaaacttagcaccacaataattatgtgaatcaagttctagtcgactttgtcagtatgcttttcatctctaaagctttgaagtcaaatcccagtaaatgtcaatatgctcctatcatgtccacacctgtcatctgcagcacaagtcagtgtgatctgcagatagaaatgaggagaaattgaacatattttatggctgttctgcttgaggcaataagaataaagtaaatcaatacttcatgtcatttcctgaaaatactgtattctccaagacatttagccagcacttgcccatttaacaaggacaaaaacataaaaagaaagtttttaactcagaaaattagcacatcaatatttctgggtcacagaaattcaagatgtatcatgcattacttcaaaatctcagttaaatacactctcaaggttggttgctcacaggaagggtaagtatcattaagaaaatctaaaatttcaggaatgaaggctcatatttaatatcctattattcctactaaaatattactaaatttatagccccattaaaaaatgtcaagacatgactttctctgtaaaatgagacctgcaaaaacattatatatctttacttacatggtatatttttctaatttttctatcaatttctatcattttccatcattcatttttaaaaaactctttatactttactgttcaacactatttctgacctttggaaatggatatttcttgactatctacccatactgtatgtacacttaagtagaagaatgtacaagttcagggagcctctgcaatagtcttttgtaatttaagaaataatttccaaatctgagcaaaaataattgggccttggttggaaaatgtaagttacaagtatataacttaaagaatattgaaatcatatttgggaaaataaaaagtatcaatagtaaaatatggtagaactcttaagtacatagagtttggagtccgagaagctagagtccaaatattggctaacctcctattaactactgatcttggggcagttttcacttctctgagccgaagattcactgcttgtacaatgggaacgcacacaatgtacagctgctctgaaaagtaaacgagctctgactacagaaagtgcctggaacatggtactcagcaaatggtattttcttggaatcctataaacaaattggtaacaggaaacatactaaaaaagagagagaaaaacagtgaatacagggcaaaaatgaaaatcattaaaaaggcaaaaaatgtcccggtagcaatgatttctaagtatcataaaagaaaacaactaggaaaatataattagaatgctatatcactaaaatccgtttttgagaccaggatgttcaattcgaaatcctaagaatgatgtgcttccccctgcctgagaaagtgccacgctcaagaaaggaggaagggaaggaattccagtccttctttgcttgtgggttttctcttaaaacttctgtttagaggaggtaggtgtgttcctgtccccttgacttggcttcaaggactagagacagaaagtctactggaaaagcatgtatttgtttgtgaggaaattagatactggattcgatactggattcactacattgtttgttcaaatgatttgtgtcaggaaaaacttttttttttttttcttttttttgagatagggtcttactctgtcacccaggctggagtgcagtggtgcaatcttggctcactgcactcccaggctcaagccatcctcccaagcagcagggactacaggtgtgtgccaccatgcccagctaatttttttaaatcttttgtagagatggggtcttgccatgttgcataagctggtcttgaactcttgggctcgagggatccatctacctcggcctcccaaggtgttgggactagaggtatgagctaccgcacttagccaggaagaacttttaaaaaacaaattgttaacaaatccctgaggttacattactcatccataaatacatcagcatgtatctccaaaaaagtaaagttatttttaagcatactacaatataattaacatatctataaatattaacaatgcttccttaatagcaaattaatactcaaatatattccactgtctcataattttctttacagtttattcaattcagactccaaatatttgcttccaaataatctagttgctgagggataagagagtgggtaattgaggatatagatgaaaaaggtcacatataagtaaaattgttaaagttggatgactggtataacagagttcattaagttattctccctgcttctgtataaccttcaagttttcagtaagaaaaatgttttaagttttccgtaataaaaaattatacagacatacatcaatgaaaataaaaagatagcaataaatataactcacaggtttgagatttttttaaatgacattttaggtcaaaaaaatgctgaaactcagaccttcctagccctgtagcctcaataaacacaaagtaactgagagtagaaagttaatttactttagtaaaaaaagcaagttttaacagcatcaaaatatgagttgaataattaatttttaaaatcctgtattaatgtgtttatgtcaggttccaccagatataggcataaaacaaaccaggtgctgccttttttggagattataggctaacagactcagtgcctgccttctatatatgctatggcgtcaaaagttgggaagcatctgttcaaacaatagtttaggattttattgaaggtcaattaagacttaactgagaaattttaaaactattaaatacatttatggaaacaatttttgcatatctaaccatttttacattatcaataatttgaaaataccattttttagagcaggagtatttattaaaagtaaatatacctaggtctacttcattagtaaaaaaagtaaatattcctaggtctacttcttaacatattcaattggataagcaatgaataaggagtactgagttgaagaagtgaagtcctatctagacctcaggaggtatggagaatacagaaatgacagaatatacaccacactaagctgccttgcctgtttcccttacaaacagcaattagaggagactccttggggacttaacatatttactcctacatatgttaactaaaagcctatgctaatgtacaaaggatggatctcctcctgcctgaagatctcagcagatgtgacagcaggttctggaagaggatcagcatacaaaggcatacgtgtccactggcagatcctgctggttgcctagtctatcaatattgcttttcctttcctccttgctaacagaaccttggcattactgagggtggcaatgtgcctagattttaaccactacacttcccaacttctttcacagccaggactgaccacatgacacagtccttgttaatgaaatttaggtgggagtcactaggtggattgaaaatcctttataaggggacagtcaggctggtttgctactttttccttttacccttttcttcctctttgtcttcctccctatacctctatgtgctggctagagctcaagcaccatcacatgagcatgaggaccccaaggatggtggcttgcaaagtcaaaaggcttcattttcctctttccctggctggagagactgcaagtttctccccaggtgtgtggaccacaggtgctgcagttggccccaggctaaaagctgcagagataagaactgacttctacagctctccaccttttctcctccatgccagtatgcacacccaaccagcatctctgcttctcttcacaatccagtaccttcaagtagttgtttttgtgatatgtccaggtttttattttggagggacatgcattccagtagagcctaagtcccttagtttttagaaacaaaattatttaaatttcactactgagccccaaagaacttctaacatctagactattaataaatggcttcttgatcagagagtgatactcaaaaagccagacccaacaatagagttcacagaaacaacagtccttcaacattttctgaagagctcttcatttccattaaaagggttttgttaatcatttaaaaaatattgttaaattactgccatgtgtgactcatggattaggtgatagctggtactggctttatatagctacagaaacagaaacaagtctatgggtgtcttacatgtcaatatgctttagatcatttcaggtaaagtaattaagcagatacatattgactatttggtgcctaaccttatggtgatgagcaaagtgtggggaagctattgaagaatatgaaatcactcttgcctttctataatcttattgaaaagaaaaaaagactaacaagaaaaaattaatccaaatcaatatataatcaaatgctgaaatatggggaaaaggcaagccaaaaacatctaccaaattatgacaaaatatacaaggctaagactagattaactgaatccactcctcctagatatgctgaagctctgaatagataacatctggtaagctgtgaaacatgaaaagcatatacagttcactggaaatcaaaagagcttaagcttactatgtgagatataatcaagaatatgggttttaatctatgacccattgtttgccaggttctttttaaatttttcattcaaacatcatatattaaacaaaagctaattttaagaataaaagtgtctccaatattttaagtctcaatgactgaaagaatggtgaagcccttcttgggactctgaagacaataccccaaaatatggtgctttggcatactgaaccaaagcaggagccctagggtctctgtgaccttcctctcccggtctctcaatcatctgtctctcccaaaccagaggatgaggctgttctctgaagttctcttgtctacctagaaaccagacccaccaaagagaagtacgttacctttgatctcttcagtgaatttcattaacaagagaaaattaaaactcatatcctagaggaagagactgaaaattaaacaccacacctagaaccctgatgaacttcatcccaaaatgaatattgaatgaatattcaagcacttcacacaaataatcattgacgagctaacttctatcttccatgttcattaaaatcatttagtacaccccacaaaattgcctcatttccctcctctctcctttccctatgaagaagggtatacaagcatctggacctcgttgggttattgggtaatcattctcctgcaattgccccatgcttaggcatgttaaacaaatttgtaagtcttcttctcccattaatctgcttattgtcagttcattttcagcaaactttcagagggtagaaaagaagctttgtccccataccattaataaatatgagtaggaagaaaatgatctgagaagaaaagagatgaggagctatgttccgagcatgctcaatttgtgtgaacagcaagacaatccctcttgtgcccactgtttatagtatgatacaggtgaagtagcgaaggctttgataacacaaacacttcaacattcacatctcaactccacccacttcttagttggccttcagcaagactatgagatctagctcccaagactgcaaaattgggatcacaatatcaaactacaggaatacattttgagaattcagtgacatgattcagttaaaacacctaaccaataataggtattaagtgttaacatctttctttcttgtttctgcttgttctttttgaatgccaaatctgataagcttatgaatctctacttcaaattgacccatttcctaactatcctcaacatcatatgcttatatctatcgcacatcttttactcctattttctatttctctcaacttaaaaaagcactataaaagcacttttatagtattaaaaatactatacatccttcaagatccaattcaaggcctgtccttttggtacataagcaatcatttcaatctgcattaggttttcctttacctcatgacatactttgctattaattaatttacatacatgtcttgcctccccagataaaacataaacttttataaagcagaatctgtgtctaaaattggttttgtttgtaaaggctcggctctggactccctctgagatcaacaaaaacttgctgaataaaggaatcagtggtgctgaccattaaaatctgaggactaatgtctattcagatataccagtcaaagtcaaatttatgaaatgtgatttttgtctactgccaactgctaagaaaaccaaaattcaatgtgattataattgtaatgaacaacaacaaaaaagcagctgttgcttcggactaaaaagcaatgcttaaaagagataatgtaacgagggacttctgtaaaagaccttaaataactattgcacaagaagataagaattaaaattaaattaattaagataatcaattccactattaaaatggaaatgaacttttatcagaaccgtggtagaatcacaagtaagatgtttcaatagttaaaaagtagtttttaaaatttgagatgcattgcaaaaaaaaaaaattggctcatgggtcagcactggaattaaccctataacaacagtaatttacatgaactattaatcattttaaatgtgattaaaaaaatacaagtccagcacacctgttcaccaatcaaaatacctagggcttgagacaatgtagtaagacaacctgtaaagctaagggtcaacaagcttccaagattggagctttcttcactctcttttttttttgacatcagtgtacaactagactcaacattcaacatgtcaattatgtcatcatcactaatctttcagtattagcaaaagtataacttcaaaaactcatttccaataggaacacacacacacattcacatacatacacacacacacacacactcacatacatacatacacacacacacacacacacacccccccgacaaaatgaaaccaacagaagctcatgaaagcatatagggaatagtttcatttatgaataaaatgtttccctgtatcttctattaaaccaagggttttaaaaatcaaattaaatcaaaatacaaaaaacaatagtatattgtttttgtagaactaaacatctcctttaaattgatatgtctttaaaataggaggtgaaaactatcgtgacaattgttctacaagattaaattaggagaaataacttaaccaacattttatacattaacatttatttaaaatctgcatattaatgaacttcaagtattgcaaacttggcaggatgttgaaatcaatgttttcagatatctatcatgatatattgagtctctggtttacttgacgtttttcctttaaaaataattttaagtagttaagcaatgtaattcctcttattttcaaaaaaattcatattctacttccttcatagatggtcactgtaaagaagtttaaactctaattaacagctaataatatgcagatagcagatacacacaaaagcttccattaaacaaaacggacaaagaaaactaccatttcctgattttctccctcagccctccctacctactatcttgattctgcaaacagcagaataaattaaagttcctttcttctacatcaactcctttgtcctctcaaggttgcctaatcatattcatctcctaaaatgaagtaagaaacatttcaaaagctgtattcacattaaatcaactttctgattcgtgcattgcaggaataaagcaatgtaatcacatcttaaattggtttacagcaggctgtctaccttatcctacttctcaggattgatgaaatgaatagttttaaaatagcactttttgaaatgacaagagaattaatagtgcataattacctcagtgttgacaagtgagagatgtttaactccttaaatgagctctcctaatgaatcagtgtcagagaaaggctccactgcatgtacatggttgattgatatctaaggggattgatttaaccataaaggaataccgaaagccagtttttaaagttatttaggcaaaaaattaaatgaatcaatttttacttaatatttggaatatatttacttaagactttaccataagctttgatagtattctaggtgttgattactaggaaaatcttattttacattgtatgagtccactaaggaacatttaaccttttaatagagtggcaacaaaaaaaacttactttagtattggactccacactacataaaagtgaaaattaagctattggatttaaaaagtagtacagagagttcatttctgacatttatatttaaagactgtaatgaagacaactacaatacaatgacgtaaatctccattttaacgaaaacttttaatacatgtaaaatatgtataaaatattaccataccatgttgaacttttaatatttatatacattctctttctaattcttgtcaattaacatgtgatactgttccattctattttaaatcctgtgggtaaaaccaaaacagattgatatttctaaacacctggaattgagaaaactgaacacggtctcagcagtagagctgtgcagttgaaatgtaacacaagccggctccaacttactcttcatttttccatgtctttcacgtataccagctgcctagcttgagtgtgtgtcaggcacggggctaagaactttctatttaattctggagattcctaagaagtagatcatactatccccattttgtagatgaggaaggctgtgcacagggaggttcctgtcccacagtcacagagggtcgtgagtagagcctgattatgcactaagacaactggaatgcatagtccacacacacactggttggcaaatatatttccatgtagattatctttaccggattaccactgttttagctatcagtgaaggtgttagattgtgttgttattcctttatcagttcaatatatttgggagtcaactaaatgctagtactttcccaggtgctgagactacaagcgcatgacagagatgaggcccttctcacgtggagaccacagacagcatttgcagggagggggatttgctttgtaattaagcgccttagctaagagacacaggtgcaggagatgcacaatttggacacttagacaaacattcttgacctggtacccgctgagcctcagtgaaagagtgagggtaaagtgtgaggacaatggcagcctgagctcccagcactaacacaatagctggagctggccatgccctccacctgggcagcaggggactataccaccaggctcaggtggactgcgggggggttgtaggcagaatgtgcagcctgggagtgtggcactctatgggaacgtctgccttaaccttcctttaggaagccaaagcctctgtgctggcactcctccccaggtactaaccctgtcacctctcccccagactccttagaagattgagcaccagggatgaaaccaggtcatcaccaatcaaattcctggcttcactgttctatcttgggtttctttaaaaaataattagatacatgaatgcctcagtctgttctattaggtgtacttaaactatgtgtcaaagctcattggaatatttcactgatgccttaaaatgtctttagcagaaatgcatttgagttgcaaacatgcaccttaaatgtgacttcccagggacaatcagctaagaaattttagttaatgttacaatttataaatatttgtgaataaaaatgtgttctaaattaaaaaaccaagtcttcattgactcgtctaagaattagggatgatgaaaactacttcttaaggaatactgaatgagttattgtagctagatgggtccggtgggctctaacacacagcaggtgtgcccgaggatggtcacatctgaatcgtgaaacaaatggacttcggattttgtttatattataaaaatctacaagaaaaacagtatttttcttaatcagttttaaactaagtcaaataattttgctgcatttaccaagtgtgtagagatttatattttaaaaatataagaagtgtagcttcaatggtaaacatgtattttatatattacttcgtaggtaatgttcctttgcttttttaaaaaaaattgctatccttagctcagaaataaaaaatgttaaaatagtaagagactttagtaataactactaaaaactggctcttccaactttccaatatctatgatggaaacccttcacacctgcctgatgtgtcagacagacacaaattggttgtttgaggggtcagaccctttcttagactgcctctcccctcctcaccccttaaagtgatacccttgaaaatcccctttactgtttcagaagaacactgttttagaagcagctataccaccacatcatttacactcacaatgccatagatgtaaatgtgagacctcagggccaggccaaatactccgggcctgaaatcctactctttccatcaatatgcccttaatcaagaggaatctggtagagcttctgtgagaatacaagttcttaagtgtaaaatctagatgtcccattaagcaaacgataccagtcaaggaactggcttttttgagctcttcctaaaaataatgagatttggaggacagccatcagtcatggaaagacatcaaacactgcatgaagacctcttgaaacctggttccacaagaaaactagaaattaaaataatgcatttaatagctcataaagtttacaagattcttatctgctctgcaagacagaaagaatcaaatgattttcttggccagggagaattcaggttcaatttttaagcccctattctgtaaccctcagtcagccctgtaggaaggtaattatcagggctagagggatagttcctgctgtttcctataagtaaactcaggagctaaattaaggtacttagaggtaaactctcagggtgtgcagagcttggctgtttgactcccgtggattctggagcaaagcactaaacacttctatttattcagagagcaggtagagaatagggcagcagaaacacggctttctcagacacctccgccagcccctgctaatcaacgggagtcacacagctcacaatctcttgctatggttttaaaatgcaacttttaatgttatttcattgtggtgtccttgtactgaaaagcatttattatgtagtttcaaatttacctgaaggttaaaaaaaaaaaaaaaaaagaccacagcaggaaagctgccattgtgagaaagaaggacataaaattcaagcaatgaattaaagaggcaaatgaaggaactcttttcctctattagaaatagaagaaacagattgtgctcgtcttgcttagggccaacaggcgcactgcatggaactcagccagcttcagtcacaaagctcacttaggagttctggtctgtgaaaagaggaaaccagatgggctatttactttcaacaagataattctggaggaaattgttatatgtcaaagaaactttttagcttcatctgctattttagcctctaaactgattcaggaagcagaggggagggttctgttaggaaagaaataagagaattggggaaataaaagcaagcgcagtgcaaaaggctgggcggccatgtcgtccaagtgcataagcttcctggactcatatcctcactctaaccttggacaagcgatctgacctcttggtgcttcagtttcctcctgggtaacatggggaccacaatagtgtcactagaggttgtaaagattaagtggtataaatatcagtacttaaaatacaacacacacatgagcactcaataaccatcaggcattgtttttatctatttcattttctcttctatttgcaaaacataaagggaatgtatcatagatatagatcaatgactaaacaattcttaagaagacactaacagctaaatgttatattggtctactgattatattgaccatataccactgatggaatttgtttgaaaacaacttctcttttgtttggctaccacaaaaagtaaaataatccagataattttattcttggatcaaaaatttcaaagagattttcttacctcaaaattaagaaagatagcttttaagaaaagtagctgtagagtgaatatagaaaagttaattaaattctaagttaaatttctaatacatataaaggatgctttctaatgagaaaaaagcagagtttccccagcaaattgtaaataacttggaccaaaatcaagataattcttatatgaatatactgtggaaaaggtatctagcaacctcatttttaggatgtacaatatctaaatattagttattaagcaaaaactgaaagtattcaaattaagttatgtgaccattaggcatccaacttaacctacttttattttacacttgtactattgctaaataataactgatgattccaagagaataaacaatactctcagaacagagtaatacaaaatatgttcagtctactgtatttaccatggcaggaaaaaggacacacattgttagaaggattattcagcatgaaggactaaaataaaaaatagttgcctggttatctttgtattgattttaaaaatttcacaaatattctatttcattgtcacattagagaaacagcatcactattttttttttttttttccgagacacagtctggctgtcacccaggctgcagtgcagtggcacgatctcagttcactgcaacctccaactcccgggttcaagtgattctcacgcctcagcctcctgagtagctgggactacaggtgcaagccaccacgcctggctaatttttatatttttagtagagatggggtttcaccatgttggccaagctggtctcgatcaaactcctggcctcaagtgatccaccttgccttggcttcccaaagtgctgggattataggcataagccaccatacctggctaatatttgtatttttagtagagacagggcttcaccatgttggccaagttggtctcacactcctggcctcaagtgatctgcccaccttggcctcccaaagtgctgggattacaggcatgaatctgccaccactggattttcacttttttgtgtaacacattttctttctgtaaggggaaaataaacaaataattcattaatttaattttcaaaatttatttatggctctgataaacataaaagccaacagcatattttaaagctattttgaaaatataaaaagaatggttactatgtttgatttttcatatggctagtgactcaatccagctgtgccccaagaaaactgaatgaatgttgatgataaaaatatctgaaaactgtatgagaaaccacatagacatatatgctaggaacttacagattttatgtcccaattaaggcctgtgaataaacggagatgagtattcaagataatagaagtagaaatcatatctttgtcttaattaccatttataaagttaatataaaataaaatttccctaagtattgcagaaaagcaaacatagcaagacaattttacattgtcaataaactggaaatgggcaggaaagctgcttcctttgaaacaacctaacacggctttcatgacactgattcttaacagtgatgaaacattaaatgaaacatgaaattgattagcctctttctcttctatactccaaattttctcccactttgaaaatatctattatttcactaactcaaaggccaaaaatctaatagcgtttgttactcattttcgaccactggcctaaccccattccaggcaccttcagaaataacactgcctttctgccctgacatagagtcagagacctaaagagccttgttgggagagcagtcttccctgggcctacatatcttactgcaggggcccccaagccgcaggccataggggtccgtggcctgttaggaactgggccacacagcaggaggtgagtggtgggcaagcggagccagtaaaccttcctctgtatttacaggtgctccctatcacttgccttaccacctgagctccacctcctgtctgatcagcagaggtattagattctcaccggagcgtgaaccctattgtgaactctgcatgtgagggatctaggctgcaggctccttatgagaatctaatgcctgatgatctgtcactgtctcccatcacctccagatgggactgtccagttacagcaaaataaactcaggggccccactgattctacactatggcgaattgttatttcattgtaatatataattatttcattatatattacaatgtaataaagggcacaataaaggtaacgcacttgaattacacttgaaaccaccctcctcgccctgatccatggaaaaattgtcttatgaaaccgatccctggtgccaaaaaggttggagactactgtcttactgggtatgccaagacatcaagggtctgaacacttttttttttttttttaataacctgggctacttctcaggttgctttcgcaggtgagagatgaggcaacctctccccttggacaaacagcagactgacttactgcttgttataaaagcagtgaattccccaaactcagagttccttagttgcaatgcaaactcactcattcatagcatccatccggaccataggaattgaaagcaagggcaattgatgccaatatgctggtgctcatgctgcttattgtgccaagggtaataaaacgttttctttctgacccggaagtctcatgtcttctgccagtaaccatgaaacagtaactggctaaaatgtatgagaaacgatacacataccattagcttccaaatagggtaagatgatatctcagacctgacagttttggtgaaggaacatagctatctggagaaggaaggaaaagtgtccagagattgggtccaggaatataaaaaaatctccctggaatctgagagcgaatgctcttgcctaggaggtggacagtggggtgtggtgggtgggaataagggtccctactgtcctgtgtgctaatgaggctaagagaggcaagattgaaatgagtatgtaaacggaaccgtggatattgctcactcattctcctccacgggttggggtgttatcatgacaagggggcagcaagaaagacaatgtgggtgtggctgctgagccaggggtcctcaaagctgacacagtgtctcaataataatgacctttttacctgatataggtctttgtgcggaccatcaactttagaagtctggttaagcctcacataggctgctgcttgaaagccacagtaaatgtgccttgttgattaacacggagctgctgtccctctcatactacctgatccctcccttccctctattctgaactcagctgctttaaggagaaggatgactgggctgggtttaagatctccctatccccaggggacagaaagcccctggcaccccctacaaacacacacacacacacacacacacacacacacacacacacaactgtttggtatgatgaggaagaaaggaactcaactgttatgagtccaagttcccattcttcctggcccatggaagaaaggcacactgaactctactaatggggtttagtgcttcccagtgggaaaggggaggtgaactagccttgtaaaggtgccctctgggcttattcaatgtggtgttgtggtagcagctcccatattcaattctataataagaactgatgtattacacatttgcacggcctaatccctgaagtgtcagaagggcttttcatgttccagaactgctgcagaggcccctgcccactataatagcatcacctgtttgatggagctacaaagtactttaaaaaaaaacaaaaaagcagctgttatcctgcaactaagctcttgtggagaaaaatgaacagctgaaatcccattttcaggtgaatctccctaaagaggtgggaagggcctaagaggccttcctggtcaaatggaaatggtatattcaagggcacagtgcatccagccctagcatcacccagtattaaatgaaaataatggcagctacttctttggaggaaccatatcccccactccactactggaaacagagctgctggttcaagaaggctctcagaggttcccatcacggatggcctggttcactgacagtttgatgaagctaaaagccgatggtggtctctgaccagcagcagccaaaaggaccagtcagcacatttctctgtatgagagctctgacccttgtcagacaatgctcctaaagaccaggcatttcatattttacagactcttggactgctgtaaatgacttgtctgctttgccatttggaagactacagactggcagattaaagagcccctctgtaggactacacattttgaaaacaaatcttggctgctgattggtctgagtgtcactgatacagatgcctgcagtaagtgcttattctctgatgagaccaactggaatcaagctgttggtcaaaactgctatttaaaaaaaaaaaaaaaccaggaaaagtcatgtggacatggctggccctgaactattccgctgtgccgatgccaccaacagcatctcccaaacgtggcccttcccctcagacctgtgcaaacacagattgcttcaacactgttccaacctgacatacaaattcataggcttctcctgcctcccaagcagccgtagctaatgccatgtttagcaatctagattgcagcaactcagtgacactatgtggcttaatcaaaccagtgtaatgctgattccaatcaagtgtagcaacaaattccaaactagagtggcctgtgctctctatatgggggaaagtaggccacagaatgtctctccattaggcatgagggttgctttctgaaacagctattatcattgacaatgagacccaagaggggcaagtcattgcaaactttcttgcgcagatcatattaggtagcagacttgtcttgcaccgtctgaattaagacctactggtctccctctgggatttattcatagtaggctgaatcagagattctggtcggggaaggcagagagactggatgaagtcaatactgcaggttggcttcatcctgctgcttaggattttattgattgttgccctaattaaatgctggtatgagacaagttgactagtttggttccaacctctgttggtccgattaatcagagtgactacaggtggcctattcatgtaaaaatttaccaaaagccaagatggggatggatagagacagttttccttggtcttcttatactccctgcatgtcttgttgggataccaagactgcattgtcctgactgctcttttacctgggccatttctcaagactgcattgtcctgactgctcttttacctgggccacttctcaggactgtttatacatctgataaccttaaataatgaagtaatgtctaaccccagacaaagagcataggtactgcttgctataaaaatggaagattccctaagctcagcagtcatcatctgcaatgcaaacctactgcatgcacagcatccatctgggctgtatcacatcaccccgtgagattcaggggcaaaggaactagagtaaatatcatgacgcttatacaacttgccatactatgagtaataaagccccttaatctctgacccatgtctcatatcttttgccagtctccatgatataaacaggctaactcattagtttgtaagtagggtaaaaagcaaagcccagatccaacatgtttatctctggcttgcaccacatagggcatatgatagaaacctagttaagacaatcatccccatacttaatgtccaaacatgaagttacatagctgtcctaaagttgaacctgtcttctgagattatttcatggaagcaagagaaaactattaacatatgaatgtaaaaaccagggtcacttccccattttccaggcctaacaaacttatgaaacctccacataaaactagggttactcacttcagttccggttcctccagagtaaaacccctctgaaggggcactattaccaccacttcaccacactagagtgtggaggagaaatactaagtatatgagatgctgtaatattatagtttgaacggaagggtgatttgagatgtgaaagaaagtgaataagaagtgctactagacatgggcaatatactttttaaattccaaacttgatttcaaaaagtagaatcaatcagtcaaataaacaaaaaacctaccttcaaggaggtggaagaatggcaagaaactggtatttataaaattaggtctctttggccaggctcacgcctgtaatcccagcactttgggagaccgaggcgggcggatcacgaggtcagaagatcaagaccatcctggctaacacagtgaaaccccgtctctattaaaaatacaaaaaattagccacgcgtgctggcgggcgcctgtagtcccagctactcgggaggctgaggcaggagaatggcgtgaacccaggaggtggagcttgcaatgagccaagatcgcgccaccgcactccagcctgggcaacagagtgagactccacctcaaaaaaaaaaaaaaaaaaaaaattaggtctcttttgctacaagggagggaaggcagaaaaagtatgccagattcagggaataaaaagtgttaagaaatatcatagtgttatatcccattatcaaaaatcctacaattagggttcaaaattcaccttcagaaatttaataaaaagactcaaatgtcaccaagtgctttatgtatgattattggcaaaatatttgtctgttagctatacttatactgttttgtaaaagcaaaaaaaaagaacttaaaagacaggatgaaataaccattcagaagcagaattatagaagctaattattaaaataactcagcattatatccagacctctagctgagcagatatcaaaggcaaatcagtaaatattctaaaatgactgctctgtaatgtatatgattaaaacaaactgtgctaaaaattaagaaaattcacattgcttcagaaatttcacattcacttgtctccgtaattcaataaaaataaaataaatggtttttcagaacagccaccatcaggaatgtgacgtttgatcatttctccgccctgctgtgagcaatgaggtaaaggtagattttttattcacaccactctgcatcctcatgggtaagtgaggctgtcggcatgtcccgtgacttaattatgtggtggccctgctggaggtgtgcttgcttaccgtaaacagacgcaaatatctcaaaactacccctgatttacaagaaaaacgttcaagtttaagccagtctttaacacaaaagaacatctttagaacaattgtgaaaaaaatcagacttccttctttgctttgcgtcacggggcctttgtctaaccaggggctgaggagatgcagggacactggtgacagggagggaggggccctgagagcaggcactgaaacaaacctgctcttcccattttttaaaaaacccttcggaataatttaaatgagctcccacccaaattaaattgccttgaggttttccctccaaggcttttggcattataaataccccctgactttggcctgccatgtttcctccatcaatcacggagtagcctagaattaaattgaaatgattggatcaagaaaaatcaaatgttttaacatttagtttcagtaatgtgattacgaaccttttagtgatattgtaattactctgaagctttgagcatatgtttctactgagagcatttcatggagaaaagctgcattagggaaacaagtaaatacagaccccaatgaagcaaaagtgcatttgttgtaaagttaaaagctaaaggtggaaaagagacaaagcatctacgtaatttacaccctaaacctgctgcatagagtaaccacttttaaaaatctctacttcttccaaaattcaaataatttaagcacttccctctaagggcaagcattaaggaagcagtaagaagaaacaacagtaaaggacaagggaaaaaaagaagaaaggaaaaagtcatcgtccttgtgctaggtatttgcatggaaaagatgacagacaaagctctctctcttaaaattaatgaaccatctcctcagatacttaattttcaccaaagtcaaggcatatagttacttcccctatttgttaatttttttctcccatctcaacacctgatgggattctgctaggctaggagccccaaagataaatgaagtggggccccaccccaaaggttaatatcaaaagagactggattcctcaagggacatggaagaagacaaaccggaggcaaggacaaaggtcttctctcctttgaatcacactttcatttaggcaacaattatttattaagtatgagcacgcttattccctcaagaataaggcaggtaagtaaagatacactataaagatggaatgaaattcggtttttaaagtttagaggaaaataactctgtcaagacagtctgaagtacacaaaccttttgaagggtttgtttcttctgattatattaaagtacagctaattgccctaatagtttaaagatcctaagtgggaagctgtgtaatagctccaagtgcttaatttggctactggcaattttattttatatttcaaatttgaattcacatctcactttcagcgacaagacacagccacttcctactgccttagagttcctagcattaagattgagcggttcctcattactcagagcaaaacctgaattctccagtatggcatggaaaactgcactgagctggtcctgacaccctaatctatcatcacctcccactccatgctccctgtactccatcccgtcaactactcatccttcccaacacagcctctgctaacaagcctgccatcttgctggggccagcctctctgtttcaaacgcgctttctttcttggcctgctcaggagtccagtctgttgttaagatccagctcaaataaattccacctctgctgaaggttcccctgctttatcacacaatgaagcgtacctccatgataacatctattattgtcaatggttactttccatgtgtacacagcatcttcactaactgtgacttcctcatttagatacgcacgcctagtgcctatcataaatcctataatttaaggtgtcaataaatatttgccgaatttaacattttcttttttcagcaaaaaataaatgttttcttctttaaaaaccaaattctgcattcatctatttaaaaaatttattccatattagagtttctcctaactgtactaacaatgtataagggaatattttccaaatgtttctgttaaaactgcctcaagaaaccaaattctatgctgacatctgtgagaaattacaagatttcgctctttcgtccttctcaacttaataatttaaaattctaactgtataattttcaaccaacccatattagttattatttacaaaggacaggacaatgttaaactattccagggagcatgaagtgtctaacgctcatagggaactgtcaaatcagaaagcaatatacacataatggttatttgcttccactttgcctgatcatctgttatgtgaagtggtatctcctgtccaaagcataacaaaacttccccttctctacaggatacaaattagcaacctggtacatatcaaattacccagctgcaatgcactatgggagtccaggagaatattcacaccttcttttgccacctgagaaaactaccttgaaaagtgagttatgtccttggctagcttcatcaactagtccatacaccctacccgcctgcgcgcgcgcgcacgcacacacacacgcgcacacacacacacacacacacagactcctcatgtgtaacactactgcattacctttaagtgacctcacaataggcaaaaatcaagttgtagctctctgtcattcttccttcataaggaagtacctaaccatacgttcaaatggtgaagcattactggtaactgtggtggctgaataatgcctccttgtccctgaaacctacgactgtttcccgatatgacaaaagggactttgcagatgtgattaaggatctggagacgaagaggctatcctggtggctcctgaatgtaaccccatgtgttcttttaagaggaaggcagagcaagatttgatggcagtaaaggagaaggcaatgtgaccacagcagcagagactggagtgatgtggccaggagccaaggaatgccagcagcctccagaagtgaaagaggagtctccacaggagcttctattaatggaaggggctagcccagcgaacaccttgattttagtcccttttagtcactttggggctgggcacagtggctcacacctgtaatctgacaactttgggagactgaggtgggaagatgacttgagcccaagagttcaagactagtctgggcaacatagcaagatcctgtctctacaaaaaataaaaaataaaaaaattagccaggcaggttggcatgcacctatagtcccagctattcgggaagttgagcccaggaattcaaggttgcagtgagctgtgtttgtgccactgcactccagtctgagtgacagagggagatcttgtctcaaaaaaaaaaaaaaaaaaaagtcattttggactttgggcctccagaactgtaagaaaataaatttgtgtttaaaagtcactaaacttgtggtaattcgttacagcaacaacaggaactacacaaaaactaatacagtaatctggccatgccccgatagtgtataatattaaagaaagtgaaattatggttctaatgtttgttttcctgaaaacactacttttatgaccagaacatgagcatagtatgctaccattgaaaatttatctgacataatttgacacaaaagtagaatccgttttaaatgtattaccacaatgcatttgtcctgaagattgtgtttataacacattgcttttcagtatttccaaaacattatacgcttaacgctgaagatctgaaaaacacaatcataataaaagaaaacatcccacaacccaaagatataatttgccggtatacttcctgatatttttacatatacaaatggcccctaatgctatctagtttccagttatggtaactaaatggtcacattaacactttttaaaaaagatctttcccaattattaagaactcacacatatttgtccatcttagatcacttaatcatcctatcatcactgttttaagacaaaaaaaatcttattacttctaggaacttcatctcaaatagcatccccatcccctctctgactgactttacctgtataacttgcattctattaagcataagatgattaaattggctgcaaaagccagaagggacttttaatgaatttacacactaagaattgtgacaactatgtcttgatccaatatgaaagtttcttagatgttgaatctccattaaaaattattccagaggccaggcgcggtggctcatgcctgtaatctcagcactttgggaggccgagacaggtggatcacgaggtcaggagatcgagaccatcctgactaacacggtgataccccgtctatactaaaaatacaaaaaaaattagctgggcatggtggcaggcgcctgtagtcccagctactcgggaggctgaggcaggagaatggcgtgaacctgggaggcggagcttacagtgagccgcgatcacgccactgcactccagcctgggcaacacagcaagactccgtctcaaaaaaaaaaaaatttattccagaactgtcccccacaaaacaaaatagagttctaaaatgggcaacaatgcccagaaattgccagaacataaaaaacaagcacagagacttggtataaaactcaagacactgagaataagattatttggtgacttctttgaaatcaagatgatataaaagtcaatacctatgtcagaagctctgcatgtagtgagacacggcagatgccacacacacatacacacacacacacacgagaaagggacaatgaataatggagaaaactctagagagggacaaaaggaagaaattccaattccaatcataggttgagcatctcacagattcctaaatgaacaagagtggaaagcccacaacagatctctacgaaatatcactctctgtatcatatgattatgtctaaattgactgcccaataaaacacatatacttcccatctgatcctatgaattcagacatattcatgtaaaaacgtctttatatattgtcacatgtaattatacaaatttggtgaatatcaactggatcatgcagtctacatttgtctgtggtcaggagcccagagaagcagcacctcagagaacatgacctcacttgtgcttaaatctgtacctctcacactctgggaactcaccagagagctataaaggactttcaggagaaaggaggtcgaatttcaagggtggagagaagacccagggcacagggaatattattcttaaatctgtctaattctccaaggagcaaacctaacttgcccccatcctctagctgcccagagttcatcattcctcaattttgtttcaatggaaaaaaaaaattgtaatcaggactggatttgcctggaaggaaaatgcagagccagagactacaaagatttccattgcagacaattcccaatctagggaatgtctccagtaggagctgtggtgaagcctggtctgttccggtcaggccactcctgtgataaccctcagaaacattacaacccacagtcaagccctgtggcaacaagtaaggaagaaattcacctgttgttcagacaacagctgctcctttgagctgaagaatgaaatattaaattccagcttctgagaaaatcaaggaatgtgggtaagaaaaaaatgaggggacagaaaagagggagtgcaggtagatgtcaaaaaaaaaaaaaaaaaaaaaaaaactaaaggttgacctcagaaacacagatattacaaatgttccttcctatttctccattttattaatacgagcaagtttcaggtgtctacttcctatcatttcatgatctggaaaatggatctactctgcgggtacaataagctttaaaaatgactacgcagttacagagggcttcatcacaagatcttatttatgcactgaaactccaaaaatatctcacaataggagtaactggcgtattcaacaattatgtaaataaataataaaaagtctcaatcaggacaccaatattaactccctaatcaccaattttccccctcatttgatgagggtaggagtagagatgtgcaaaatgggtgaggctgctaactattgaacattctctcctccaaagttaagggctctcatgtgaaactttatgggggcctctgttcaggtcttacagtaaaagtaaattggagagaatcatcaagaagccatcaatactcttaaaaatacacacatctgtccatagatggtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaggtgctgggattacaggcgtgagccaccgcgcccggcccatagatggtcttaatatgtgcctaggtatatgagtcatgcagatatctaagaggaagaaactattctgcactattctgggtgacacgatatccacagctctgatgacattgttctctccacacagagaagaaactataaatagaaccctaagcatcatgttccacatatcaaagaaggagatacaaactatttttggaatacaaataaagctttagtaacatgaaataaaacacctgtcaataagagacattaatctattctacaaaaataagaactttttaaaaagaaatatggcctttaatcagagatgatgtaatgacatatcaaatcaatgtcaacaccctgagaaaagccatctcctactgcacaattaccctgccattctcagtcgaagactgtcctctattaaacattatctggacttctttcctttgttttatggagtgagtttataaacgcttgttctccgtaactagtgatttcaagtattctgttttatctaagaagtacaatgaaggtcatgagaagtcctctattaacactttatctggacttgctggcactagtgtaactattttctacaacgttctatttcataactttctagtactgccacagacatctttctaaaatacaacctgttcataatgctcttttgtagataatggttcagtgactcctccctatcgccaactttaaacctacctccttgacaaagcttatctggtgtgcctgcagcctcaccagatacctttcattctattctcttctctcccctccatgcctgtctagaaggccgccttcacctagttaactcctacttgtcctgcaggaaaactggaatggctccactgggaaacagctggatcttccaagctctataggctgagttttccagtacttccttgtataaacctatattatgatacccacctttcaggtttgtaaatctttacttttctgtaccccttctagactatgaacaaggacctgatgaagggtagttactaaaatgttggctgactctaaaggaggtgctaattgcctcacactaaaaagagggtaagaggtgacatggaaaatttcacataaagttggtgccattggaactggatcttgagtgatgaacagtagttttgagatgttcaacagaaagaaagggcattcagatcaacgagaatcaaatgaacaaaagaaacatgaaaaatcacgtgttgcaggcatgtatgtgtgtgctgatatgtacatacatctttctaattactcttcttctgtggtggtgaaggtgcaatctataccaccaatataagcctaatcagcccaactaggccacaaacttattgggaagaaatggtcatttctatgtaccttccccacaggcaatatatagacaaatacaacctatgtgtacccatccctacccagcaccatctaatacatatggtataaagaaatgacactgaaataataatcataaatacctattcattcaaggaaaaaaggtttctatttggtgaaaaacagacatttgagttaatctgttaagagtcctaggtaattaggaaattactgggggaaaagaatcctattactgtaattccttttaaccaagattctatgctacaggatgaagtaaataagccagggaggtgagctgcaacataaatcagccgactgtcacatgagtctctttaatattacaaaattgagggagagaaaccattcagattactacgaagaaacatttaaaatgagctcattaaatgcaaattaaaacagaaacattgaataagcactgggctacaattaaaggctgcagaaacagcaggtaagaaacaattttcattgatcaaagaactaatagctaacagaataaagtattttgcattaaaactgctttcatgaatatgaagcatttcgaagtaagaactcttttttttgcatttttcaaagaaactttggaggtaggaatggatttacatatcttaatacaaagtactttcattgtatcattttcaggcaatgaaactatgaggtttcaaaaaatgcagacttcaaaaacatcctcagaaatagggccaaaattgtaaagggcaaagggtcattttagagcctttggacccaaggaagaactattatataattacataaaatcttctatgcaaaactttagtagagcctatttttgacacaattttacctcattataaacagaagctttggggtacttaggcatagagctggttttcatcaacttatcaaaatggcagggcaaagagcagtacacagtatattcaactagaaatataaattgagactttaaaattcactgcacacaagcttgaaaacaaatatgcagatgtgtagccaaatggtgaagtcggaatatacattcctgatggcaagggactttttctgttgtgttccctcgtttccctggcacctagagcagttaagggtacatagcaggtgctggaatcactggatctgcttttgcaaaactaacgcactataagatgagaatgagaagttttcttctaaattaatttgaaaagttaaaagatactgtttttcatctgtcaagacggcaaaaataaaaaatcttcgatggcacatgggaggaaatgggcactcttatacacactgaaagggagggcagggccaccaaggacagttgtgcagcttgtacactgaaaggcactacccctagggtgagagagaggtgggggaccggagatccaggaggcgttctgctagtgaaagctgagtcagtctcaggaaggacgtcttttggcaattttcagcccagaggggcagggcagctctttactaccatgttgtattagtggaggctttagataggcttgtaaaattgggcaacttattttggaaaaattttgaaatacctaggaaaatgtaaaatctacaaactctttaactcaaattgtcatacgatttttattttacatctatgcttacatgtgcaagtaaaaagatatggccacaaacacttctgacaacagttgtctgtaaacctaatgagtgcttatttattggtaaatattttcataattagtgtatcctataaaagactaggcaggaatcgctgtggagtggatctggacatgcagatatgtaaattctcaaagagatgctaagtgaaacaaggtatagaagagactatgttccaatgaatggtttttgtcaatcaaaaatcttcttaaaagtctaagacactgaatgtgtatttcaatactgacaacattgttgtatatataaccatgcactctaatatctgctgttactcaaatacctaaatccagttctacagaacatttagaacataccacaaatatccccactaacattccattttaaacacaaagaattgctcatttttaaaaaagtcaaaatatatttttaatagaggtaccaaaaattacatttttctaaattgaattcttttaagcttttctattctgctttatatcatcttgaagtccttctccacactttccacaaaggcacaatttttaaccgacttcaattaaattatgtttctgtagctgcctgggtcagggcattcaacacatcaatcacaatgcaggtgggaaatgtaagtacttttgaaacagtcctcatgccaataagggaatcttcggttttgagaaagtaaaaggaaggtacatgtcattagcagtgaggtcacagtcagtcctgtttactcctattctaccaggaaacccatctttacgtttctccttaaactaagccaggatttaaataaagtggcagaatattattcgcagtaaggttgaggcgggaaattaaagaacaataaaattaaaaagaaagagaaataagttttcctgttttaggctaacttgttccagaagcagcaacaggcacagcctagacccaggaaaagtcttgataatattatctaatatgctctggagactctctcagcactccctcaacacagggagaagaaaaacaaattttcctttgttttacagaatgagtttatagactcttgttctctgtaactagtgatttcaagtattctgttttatctaagtagtacaacgaaggtcataaaaagcctgagtaggcctgaactacagctgcctgggcaccacagagaaggttataggataagcctgtgcccaggcaaacctagaaaacgaacatctgggttgcttggcaatggtcatctgcaatcctgtctttgtcctgcctctgtatccctgctttcacgccactgtaagcttgcttcaagctagcccacctccgtttgtgaagtgtgtataaaagtcaagtactgtctttattctgggcccagtcttttggatgtgagtcagctgggcctgagtacactcaataaagattctcctgcttcaacctgaggtctccctcatactcccgaatcccgcaacaaggtgagtgtaatagttagagaaagcataggcctgaaaggagcaagctttgagaagcactcttacctttaacagaaaatcccagatacatactatttacattttagtgatcactggataaagtctataatgtctttcctggctctgaatttttgtcacaaaaacacaaaacccatcactccaaggcttccttttaatggttttcactttcacctacctttagcactgttcacgacacccaaatcccaaactgaccattcagatgtttactgaaatgtggctaatgaggctgggcgtggtggttcatgcctgtaatcccagcactttcagaggcgaatgcgggaggattgcttgagcccaggagtttgagaccagcctgggcaacattatgaaactccatctctacaaaaactataacaaaaaattggcaggcatggtggcacacacctgtagtcacagctactcaggaggctgagatgggaggatcacttgagcccaggagttggaggctgcagtgagctgtgatggtgccactgcactccggcctgggtgacagagacagaacctgtctcaaaaagaggaaaaaaaaaaaaaaaagacgtgtgtctaatttcagaattaggcaatgcaactagttgaatattttattgcacattgtccatgatcttatatgtaaggcacatttcctagggaaagcaggcatggatttaatcatttatgttgtactgcacacttatttgcactatgtaaaaccatggctggagtgagagaaataacacttttaaaaaccaaccttatattctccatgtcattaccagtaattgataactgtttaatcatcaactccaaagatatttcttccttattggaagaattccagataaaactaaacagaactgtccaaacacatttcatcctaataaagttatttatataatcacttattaggtcataacttataactgagtaatgttctttagatcttaagtgcttgtctttatatagctttacaataaatttgtttctcttaaaattatctgtgcactagattaagttaaattaaaataaaatgtatttaactgtcttcaaaataaggtataggctattttcttcctgtagactgacagcacagatattggaaaatctcttctacttggttttctgattcagttcaaacttgtgcttgcaagtgaatcttacgtaaatgtcacctaaaaagagctcaagaagactcataaaaaatatttttttcgtaatttgattaactttcaagtcattcaccaaaagtcagaccatgctagaaagggaagaaaagttggacaacattcttgttttaccacaaagaccatgccagttagctggcttgattctcccactgatggggagaatgtttacattttaacaataacttcacaaataaacagatgtaagaagtgttttcagtgcataaagatcatatactttataaatccacctctcatctttcttctggacagaccacatctgacttcgaacgtacttactgcaatcaaaagtgttttgtaaaggaccctcctcaggaataaacaagctcactaaaccctccatacataacctggagaaacctccacaataatgaaaccccatctagcactgtttttcaaacatatggtgcatttccattaattttcagggatagcccctaaagtaacttttggctcaacaaccctggaagagaggacctttgctcatcttacacatcaagtgttcatgaacaactctgatgccactaagtttcgttcacaaacttgcacctcggtcgttcttttacaaaaaaaaaaaagaaaggttattttgcaaaaggcaatagatttaatcttggctactatttactcttaatgtttctttcatctcagccctccaatgagaagtttaaaaggaaacatccgagggagcaagtttagatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgaggtgaggggcgaaggtgaggggcggcggcggggcgaaggtgaggggcggcggcggggagaaggcttcgggaccccacacggtccgggggaccgcgaacgaggagcgggggtgcggggccgcctggcgtccccgtcgaggcggtcttcatgagaacgctcagagcaggggcgggcaggcgagggcttcgaacgcacacactggggccccggacccgcgtcgctgagctggggagcccggcggcgcgggccggggacggcacgggcactttggccccgtcattgacagttggcaccgggggtcctggtcggccgaggcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaat

SEQ ID NO: 980 - DNA, 1380245 bp, Homo sapiens; identical to SEQ ID NO: 979

SEQ ID NO: 981 - DNA, 1380245 bp, Homo sapiens; identical to SEQ ID NO: 979

SEQ ID NO: 982 - DNA, 967552 bp, Homo sapiens
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctgccagctagcatcgttttcttttgaagtttgctggtctttaaaccaaaacacccccctcaacccagaaataactattttaatacgtcctttggtaacgtctttaaaacacattagtgaactggttttgctgatggtagttttaggaaaattaacttagttgtattccaagatacagctaacgaacaatcatggtaaggaactcgatattctgagattggcgaagatgagagcattaaacttaaattagctgtgttctgtgtcctgtgaagatgatttatgtgtagtaacatgacttaaatgttgtaacattttaaaggtctgagctcaaaactatcatccaatagcttaacaacgaactcatacttttttttattgatgcttatgtaacgttatctaaattgtgcccctccacccccctccagctttcataaatgctccctcttatgttttactacatgaaaacaaattgccatatttctggttaatttaactcctccattacttggaaaattttcatttcacttatttgtgctttttgcttaatgacttactctggaagaaaagcatttattaagtcattttgtacagtgggatctgtagattgttagagcaaccaggttcaagtgaagaaatctaaatcacttaggatgacctttaaaataatgtgtttattaagttttctttttttaaacagtgacttgcattttgcactaagacctgtacgttcatacatttgaagattggtgcacagactgaaatggtggggaaaaaatctgccagtggctttgttttgaagtatattacatagatttcaagtttttatcagttgcactttgaaggttgtgtaaagcattgcattttaacaactgaaatgttaatgaaaatacattttaaaaatatattaaggcaacaaccgaactttgttaggaatattttattcctttttggcagtaaaaacattggtacctgttttacatttatatggcttatgaaagtgtacagatcttttagtgtaaaatttcagataggttgtcacaaattttaagttcattgacgggtttctgttctctttgctctgtgaaatgtgtaatatatccatctttttttatatcgtattgaaaattcatattacagaggagatgtcaccatttgacaaaagctcatgtatcttgaaaatgaaaattctggtgctgttataagagatttctgatgggatgatgagttggtcatatgtgcaggagtgcattctcttgaatcttatcagatgtaacattctaaatggaatagttaccactacgttggagcgcctcctaagtaccatattattacattgtagctaggtgaagctatgactaatttctctgcacctcatgtaagtaggctaggtcgtgtattttgagaaaaaacgtgcgacattgatcagtaaaagttacatttttataacctaggttacagaccctctatgtaactgatcatgatgggaaccgccaggttcaggtcttccaaatgtaactttaatatgccctggagtttcttctttctatgcggtgatgagaatttctgagttgtatgctctgcttattgctgtgtgtttaattgcttgtgactttcccggattcctaaaaagccaagtctttaattctggaaggcaggtggcaacacatgctttctttatgccatccaccaaggagccagctgtgagtggtttggaaggatgacttctgaggctaaagatgtataagcagtcttatgtgtgaagtccgtggtgcctttagctttactgctggactctttacaggcttactgattctggcagtgttcagtagacctcctagattcagcttgcattcctcaggcctagaaaggataggaatgttcttgtccatggggctgtttgttcatagtcctcagtttctcatttgaaattgtctccacttggacctatggttctccagctttggtatgtgttagaatcacctggggaatttgatgaagctgtagagtacctactcttcctcttccatgagccacatttgctttccatgtgattataatacacattggaattcgagaactactcacttattaccttgtgtttccccctattccagacacctgctgacttcctggaaactctctagcccagtgtttctcaaacttggttgcacattggaatcacctggagctttaaacttctgatgcctggatgtcactcctagaattggttttaataaacttgaggtttgatctgggcatcaggatgctgagacaccccctcctccctccaggtgattctcatgtttagccaagtttgagaaccactgctctaatggttttacgtgaggccacatggcttgatttccctttcatgccttcctgggcttattgtcctcccccaacaattgcagtgacttttatggaccttgggcctgtgttcacttacacctgttccaggttcatgatttgaaactcaacagagtacactagcttttcacttatgtatcgtttattcctactgaaactgttgagcccctgctttgtgctgcctgaggtgtacatcggaatcactggtgaaaatttaaaatacagttatctggactccacctcagaccagttggttctcagaagcatgcatttaaaaactcctcaagtgattcttgtatgtttgtgttactttttttattttttatttttaatcctcgtgttggttaatcccataatgtcactcaatttctctgtcatccttagcctgatttttctgtggtctgggtcacttttctcaggccaattcccagccttggacagggtgtactaattaggcatttctgccacttgtttgctagagtgttgagttcactacaaatctagcttccttttgggcccatgttgctttccattaatccagaagtactttgcttcccctcctcctaacctactccctttacaactttgtaatttgagtttcaactggaacttgagttctagactcccttacttgaatatcatcttaataaagagtcttgcttagtgagtgctcagatagttaattaaattttattaggccactgggtatttaacagacaactggtctcttggttggttactgtcttccaaatccaacaataagcagttattaccctctatgcagtctgcatagccacctgtagctgtcctttattgaacctttacgtgccaagcactaagtgctcatttattcttcacagcagctcctgagaggtagacagcatttttgttctcatcttacctatgggaaaactgaggcattcagatgttaactaactttcctgaggtcccaggaccaggagtggtgatgccagaatgaaaagtctgatccagagtctgaacataacttgagttcataacccctgggctggagcgtttcccatgtagcctctgcctttataaggagagggaaaaatgggcagcaatcagatctgtaccaaagggaaagacggtggttgatattttctaaaaacagtattgagtaatctgacctcaagttttagataaaccttatttacgattatgattgcaaaataaaaattacataatttggaaaatagagatgagggatgtatgtaaccccttccatctacacattcgtctcctctaagaaaatgactatcaccattttgatgtattcccctaccccaatttttctttcataacataacatgaattccagcttcatgatggtctgttggcagagattagaccaccccagaatggactactgggagtgcaccaactatttatttgaggaacatttggaaaattcttttatctgcactgaagtgtatgaatttgagtcctttaactaaaggaggtggagtttgtaaggtactgatcttttattagtttgccttagcacacattttatgtaaacagttaagtttaggctatactggggtttatacctaaccagaagtttcctgggccctcaaatactgagataaaacaacgtggaaggctgcaagttaagtgggtaattaagtgatatcaggtaagactgtgtagtttaattctccctaccagttgcctttatgttatttccatcctcagagcccctgtattgcttgtattggaatacataggatttggcgtctaaggtggcagaggtgtgtggcatgtagtgtctttctgcctgcctgccttacggtgtcccagagatcagagactggtaatgtcagctgactgaaactagagaatggaatggacacaaagtgaggattctgattaggtcacggcttaaatttctctaagaagtaaagaaagtggtagttatgagagtagacctccaggtccaaatgcgttgaaagttgaattaagctcaaggtggggaatgaaaatcacattgaaaggtgtagtataaagaaaaattaaggtttatttacaaaagaaagctattgatgttttgttatttgattaaatactcctggtacccaattatacatttaacccaaagtaaccgagcattttaatttgcatagtttctaaaattttatttgacttcatttctgtaaggcattatcttaaatttccccctaagtatgtacacctcttttttttaaaaaaagggcataaacgttcgtagccataatcctgagggaggacatattttgtcagttgggacagcaaatatggcacctcctgccatcctatggtagcaagtagaaagaagctataggttcttcagtgaatccctgaaatgcaaaagtctgtcacagttagatacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaatatatttcagttttagagtaaggagggattttgtatcataaaggtataacctatcatacttaactaagggtgctgatttccacaggtggtagtatttgtgagtccctctctctggtgtgatccttaatttattttgtgtgtttgtgagcctgttttcaaagtgaaggtcagttttgtcttctctctaggtgttaggcgcgatgcaaaaagaatgaaagagattttgatagggtatgaccaagcccttctatacaatggatgtcagtgttgatttttatacacaaaccaccagatggcaacagaaaaagtgttcatataggatataatctgtggtttccacagccaagttttttttttttttccttccatgattcaccactttttagtatgcttaggtaacatgtacaatttctggctaagagcaaggcgagtttataatacccagctatgtgaaatcaaaaccaggtaatagaatagtggcagagtgtcactagaaaaagattttttttttttttttttacatgagtgtataaactgttcccaaagggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcatctagacagagctgttaagttgtgtggatagatgaattttgcaaccagaggagggtctgggcttttggtataaatatttgtggagacagtatagcatactgtttaagaggataggcttggcataaaataaaacaaagttaaccacttgctagctttgcatccttgggttggctacttaatcttcattaatcttgacttttcttatccctgaagaattgtgtaatgattctgcctgcttcctgtagttgttgtgagggctgattgatatgattgtaggtaaggtgtttttatcgcattaccaagtacatagcatgcatccagtaagtgttaggtggtgttatttattcttttgtgtagaggaatcctgccttatttatcttttcttttcctgtaatattagggagtgatgagtcacggtagtagagtggggagtatggacagttgacataactggagaggtattatactaatattagcctggctgggatacaacctggataaattgcagggcgatgggcctggggggagagtagagtgatggagatgagttagggaatggttatgataatatagaaataatatttgaactgcagtagtattgggatggaaaaaatggaatggtcagtcttgcttagagaggtaaatagatgagaacaaaaggccattggatttgttgattacatgggtaatggtgatctttttgagctcaatctcactggagttctaggagtataaagtagattgaagttcattatggaatgaatgggtagggagaaaagagtcaaccggtatgttcttgttctattgaaattctcaaggaaagagaactatggaggcatttgaaatgcatagtgacaaaaatgatcttaaaataccttgggaatattttttccaaatttgaaatctattattgaggctgggaaaaaaaattgtcatttggcagaatggtaagtaattatcacaattctctgaagtgatcatttctgtttcatatgttgcgactcgtggaggcttctagcaacattgtcaccaaagctgaatgtggaggactcccttcaccaccctgctataaacacacagaaactgtggacaaaatataacaagaacaaacaagcgtttctgaagtttaaaataccagggaatccctaggtgccagctatgaacagaaaattcagagctagggcgttaatcaggagctcaaggcctgtggtggtttctgatctgaatacacgccccaatggcttagtcctgagggtctcatggaggagtaggaggcatggccttgggtctgcatagacttggaaggtggagtaaaggttctctagcatcaaaccttgaagggcttttccatctgtgaaaagagaactagaaaaactttgcctactggtttgggaaagtgtaggaaacttgctgtcctcctggggttgtgatcattaggaataaaaaagggacatctaaactccaagattgcacctcataattggggtggattcaaatttaacatttcttatagtgcaactaaccttcaagctgagacaaattagcataaaatctggtctagaactatggaaatgaatagagccctcaggtctgaaactgacctgcagagcaaattaaaaatctaagactcttgcagaagaaacaagtcatgctatagatgagcttgcaatacaaaaattgcccagctacacaaggaaatgaatcaccgtgaaggagagttagcagatgaatagtattccaggagattgagatgataggatatatgaaagagattaattgcttaaaattatgagagatgaaaggggtaagatcataatgaaagagcacagattagaaaaataacatggagttggaaaagaacccagtaggacttctagaaatgaaaataatggtcattaagtgtttttttttaaaaaaaataacctcaatggacaggttaaagagccaggtagatataattgaagataaaaactgtattgaaaaatcaatagatttttaaaggagatctgaggaaatttcttcgaatacagtaataagggataaagaaatggaaaatgagtggttacaattcatgaactttagaatgaggaagtctcatattaccttctgtgagcttccagaaagaggaaatagagtaggagagacactattagaagatagaatggctgagaagttttcataatcaatacaagttctgcctgagctcttagtttcaagaaccgtagtaaaccccacacaggataaataaaaataaattcatacctagacatattgtagatgaagccttagaaaataagaggaaagcagtctgaggaaagttgatgtctagactggcaggcattttgttcatagcagaagatgattgaataataacatcaaaggctggaagtggaaatccactaccaacctagaattccatgtccatataaagtattatgatactcaagagtaaatgaaatggctgggtgtggtggctcatgcctgtaatcccagcactttgggaggccaaggtgggcagatcacgaggtcaagagatcgagaccatcctgaccaacatggtgaaatgccatctttactaaaaatacaaaaattagctgggcacagtggcatgcacctgcagtcccagctacttgggaggctgaagcaggacaattgcttgaaccctggaggcggagattggagtgagctgaggttgcgccattgtattccagcctggcgacggagcgagactccatctcaaaagtaagtgaaataaaggttgtagataaaaaacaaagttgatgattagtagttggaactactaaaaaatgcacttcaaaaagaaagaaattgaacccaggagtgaggtacagattgtaaagtgctaaatgataggaagcattgttgcaatgtgccccttaaatttatatgtaattgctttgcagtttgagaaaagtgtcagcagtttccactacaagtactcatactgcagattaacggattagcgagagtgtaagcagtagggacgggtttgggagatgttggtcaaaggatacaaaatttcatttagaaggaataaattcaagagatctgttgtacaacatggtgactataattaatgataacttgttttattcttgagttgctaaaagtaaattttaagtattcctaccacaaaaaagtatgtgaagtaatacatataattagctctatttagccatttcacaatatatatgtgtcaaaacatgtcgtacacaataaatatatacaaatttttgtcaaaattttaaaaatgtatgtgagcaggagttaattcatctaatgcctcagtgaataaagtgctgtgttaaaggtatagtgatcaataacagttgcttccttcagagagcttatagtttattagggcatacacaccaaaaaatacagcgccaatgtgcagatgaccctggagagccctttaagccatacaggggattcagcatctggtagataagtgttaaataggaccctagcagggatacatataggcaagccatgttggaatctggggactcagattggcacgtggaaatacaaagatgaaggattcaggtggaaagctgctgatcaacaggagtgaggaacccaacacctagatcagaacaggattcttgccaaaggaccaaacatcaagaccttcatatttagccagtacattccaagtgacctttacattctgaattagggtcttattgtcatagctgtaggaaatgtggacttggatcttggccagcagagagttagattaaatgtgcagggtgaagcactgttcagagctgagataaagcatacacaaagaggcaagtggttgagatggagcagctcagtggatgagagttagttacagatgagattgtagccatttgcatttttgtggcaacttgatatgattggttgatgctcatcaattcctgaattttgaaaattacttatatctgtatcatggaatgttatagttggaaagacagaggccatctgcatctctaactttgctgtcttctgtggaatgaaaagcatgaaatataagttgtgttatgcttttatatagatgaatacttcatagcaattaaaatattataatctagtgttttattagatgtagagatgccttaagaggttttattttaaacccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaatccaggcccttttaaatatataactcctaaatgaaagataccagacccaaacattatgaaaagaaggatatttggggagtgcatctctcatttttgatcttgcatgttgtgttgtatggaccttggaatgtaattttctgtagaaatatttgaaaatgtaatttgatacccagtccacactgcaaaagcctatttttttttttttttgtcagggtcttgctctatcacccaggctgtagtgcagtggcacaatctcagtttactgcagcttcagcctcctgggctcaagcaatcctcccgcctcagcctcctgagtagctgggattacaggtgtgggacaccatgtctggctttttttttttttgtagagacaggtctcactatgttgcccaggctggtgttaagccctgggttcaagcagtcctcctgctttggcctcccaatgagttgggattacaggcatgagccaccatgacagatatagagacacatatggagacacatagagatgtgcatgtaaaataggcccaaaagcctatccgtatgtgtctctctatctgtatatacatttctttctgtgctatttaaaatacatgcagtcactgtgtgacatattacatttcaagtgccaacttgggaatggtggaactctgcctctcaccttgaggacagcccttctttgcagcacagtcaatgactaggaggacagtaggcctgtgtttacatctgtgcaagaatggcatctgccttcatctccgcatgctcctagagaaggagccgtttcagcgagtcacttctcaggtattctaaatttggtaataaaaggacttgatgcactccaggtgcagtttctctgaccatatcaatgttcttaatttttttttgaggggaggggactgtgtcctaattagtaattaaggttattttgatagcaagtgttagaaaaatgctaattccaagactacaagcgtatttcacattctgaaatccaggtatcctaagggaccatggactggaactccactagatactactcagaagcttcgtccgcctcatctgtctctacttttacctctgtgacctagaggtcacttgaaacaagcttcctcctgctcgtcagcttcattcctctctttctgatgactgtctttctctagccatctgagcctcctgtcctatgtgacagtctcagctcatgactttccatcccctcagtttcaagagtgtgtctgagacctgattccagaatcccaaaaggcagaatgacattgactgacccaactggagttcgttaggtatccgtggcttgttaggaatctatctctagtaggaatgtctgctgccctgggggccgaatcctgcctgtgcatgacctgctagggcccatgcctccggtggatggaatgaagcaaggatgggggctgcctgcagagctgtgtcactcacttgtattcagctttcctgcctctggctctctgtcttttacctttttttgttcgtttgtgttttgagatggaatctcgctctgttgctcaggatggagtgcagtggctagatcttggcttactgcaacctccgcctctcgggttcaagtgattcttctgcctcagcctcctgaatagctgagactacaggcacatgctgccacgcctggctaatttttttatttttcatagagacagggtttcaccatgttggccaggttggtctcaaactcctgagctcaagtgatccgcttgcctcagcgtcccaaagtgctgggattacaggcgtgaggcaccacgcctggccttttatcacttttaaactaagaaaacaatgatcaccatacatgctctgcttccaaactatactttcacatccaaagtacccccagatcataaagtgccaccaaagagctgtgatatgaagaaagaccccgggtagaatcactctgaaaatgtgggaggtttttttttttttttttttttttaaagcaaattcattttacttagccagaatcctaatagcctgctgatttttgtagatgattactctgaaaacatatgcattggtgtggtctatgagtaaggctctgccttttaagtcacattctttgctgcttcattgcaatgaaaaataccaaaggtgaataccaaatcaattttttttagtattgtacttgtaaagacagtccatgaagtggtgagtgggagaatcaaacttttgtggtaatcttttattgtaatctactttcagctcagagaagcagcatagcctggtggactaagggaggatggggagtttggagctctgagatatgaactgttttgcaatgactagttttgtgaccttgagaaaggaccttaacctctgtctatgtcttcatatgtaaaatgggatctacctgatagaaacataggtgcattcatatgtgagcaaactgaataattagatctcacataaatcaggagtgattttttttttaaatggctgaagcctgcggtttataaaaagattctccctagaattcctttaagacctaaccttttctcaggggtgtttaaactgtgattaacaaatgttaaattatacatcccagtttacaaaatatacccgttgaatagagtgagactaacatgactttttgtctcataaaattatgacaataactcagtcagtctgtgtgaaatactttgtaaacagagctttgcaggctgcagtaaaaaaaaaaaaatatatatatgtattttatatttaaaaaatatatatttttatatatatatatatccccatacctgaagattttggggtgaactttttccaggttaagaatgacattagtgccaactgtgctgtattttggctatcgtgatgacattagtatcatcaaattggtcgtggcattgggacactggcagcatgtcatcctgccccagtcaagaatgactgtaggcagtttcagtttatctgttgctactagaattttgatgtagcagtgtcaaaaggttgatttgtactatggcaatcttattcctagatgtgaattctccagggggcaaaatatcctaaaagctaacatgtaaacaagctcaaaggattaatgtagtaggaagaaatagtagtttgttatatattcatgttgaatttaggtaactattttagttatttaaaagattactaccgaagggaagaaacatattttgctaggtttcgcatagaaaaacctgtgtctggctcaaggtaatacttgaattttaataggaacctaggtttgctgtcttcccagtgtagactgtagcctgcactgtcatagaagagtgttgattgatccggttgtgaaatagatggatacccacatttaagttgcttttgaaagagtcagtttccctccacaaatatggcaacaaaattcttttataatccacaaatagaatttttcttcatctgaaagagatttctcctaaaccagcctgaaaaattgcttttctaggaagaatttcatggctgagcctcattcttgtacagattcatagcatgttattactaacttgtaaatattcacttacagaagagagtgactagaatctttgaattcttttatattggtgttgaggtttctatccaagttacgcagtttttcattcattttagaggaagattttctcaaacaaggattcttcgtggttgcaaaacctatccccagagattccagtcaacataattcaagttgaccagtggattctaagtgtgacagtacggtgtttagcaagtccaagtgaaaccagatggaggtcagagaatatgcctggcttcgtccacattatctagttatctgcctcaaccctctagtttcaaccagcttcaagtgaatgttaaaccagactgctgtaatctacacatgctttcacacttcaaaaggtgtgtgttagttgatatttggtttagtcatttcgtctcttgagaggaggggttgaagtttttatttccagtagtattttattttattttattggatgaagttgtttttatttcttttctccagaagaggtaaggaaggttcctggattattgtatttggttggtaaactctcctctttttctctttctgtgtctgcatctcctcctttttctctttccctatttcttcttcctcttccttaggtttatatgaaatagaaacaattttctagcacaatgactaagtgaattgctacattaaagactggctggccaagaaatggttaatctttgtatggcaggctttagggaccaacatcaaatacaaacatgttggaaatctttttgtcattccagctcaattgattcagaaaaattttaagagcaatagtcagtgcttggaggaaaaaagaatactattgtaaatttgagacgttctcatcttgaacatggctcttgtaaatcacaagcttgacaaccttacagagtacatacaagccgtggttgacttcagaaatatgtgttttagacacagttttacatgaaagtcatgatattgtaaatataatgatttattaataagtttaacttttgttaggatactttgcgcataactaccgcaatgcattaagaaggaagtgttaagaattttcatcccacagatctgatgatttaaagtagtgttccatttgtgcagtcaatagaaggaggtgcaacaatgaaacagaaacaaggcaaaatctatccatatgggctcatcttatgacctgttcttgctggtaattttggcgtattttgtgatgatttttttttcctctctttttgaaggctcagtagctgtactactcactctaccaggccaaagagtcagcgtgatggagagaagattaggaaatcatgttttaaaattcttctaatgcagatgaatatgtcaacatgatttttctttcatcaggagcctgtaagagaatttccaccttgttcgccttggttttggtatatgaggtggactttttacttaggtgtcctccctgttgttttgaggctatgtgccctacgccactgtggtttaccctgaggaagtttgcgtagctcgcgtgccaaccacttctcttggagaagacggagtgtcataactacagctaacatttattaaggatcttgcatgtttttcattttaatcctcacagctccttaagtattatctccattttgtagatgggacatctctggctcaggctcaaagatgttaagtagctcacctaaggtcattttgccagctaagtaaccaagctggggtttcagcccaagccaactttaccgagtgtggatggttttaaccagttctctcgatttgcctccctgtgaggtgtgagttgttgccatcattaacccaggcctatctgcttttggggttcagagttggaaccatctgcagggagtgtagatagaatcatggggggggacagagcacaccctagtggagcctgccaagactcctcattgagcccagaaaactgagatacaggttagaattggccatttcatcgcagtgtttatttcatgttttctcatctcacaggtgagttttctagaggaaagatgatgaagtaaaattttacaacaatttttgaatacttttcctaactgtcaaatctccgtctggatcccattaataagatacaaagttatatcccaaaagtaccaaattatgtaattctttttctgattagttcattgcaacttgttcagcttcaaataaattaaagatttcttagttattgtgattcttaataattttgcaaaagtctctgtatttttttttttgaaatctttttctcattatttatggaagatagtgattgggagaaagcaaaatattaggcattaaaacagattatactggagagatctattccagtgtgatcaccaaatccacctattttgatacttgacttatgaaggggactgcctttttttttttttttttttttttttttgagacggagtcttgctttgttgcccaggctggagtgcagtgacttgatctcagctcactgcaacctctgcctcccgggttcaagcaattatcctgcctcaggctcctgagtagctgggactacaggcacagacagtcacgcccagctaattattatgattatgattatgattattattattattattttgtattttagtagagacggggtttcaccgtgttgtccaggctggtttcgaactcctgagctcaggcaatccgcccgcttcggcctcccaaagtgctgggattacaggagtgagccactgcactctgtgggggcttttaaagaggaagtgaagggtaactcatctctatcctactttacatgccccacctaagtccaactcccactgcctgtcttctaagggacatcttgtggcttgttctctgctctgctcgtattcagtctctacgtccctcatgctttctcatggatttacaatgattacttactctcaaacttatatttccagccctaacctctccagtgatcatttgttaacaagattgtgttaaaggaagcaacaaaggttcttctattggatgtagttgaaaaagcagaactgttgctctggcctaaacattaactttggagaggtttaaattctgtttagaagttataaatgagcttaatatcatgtgatttgcatgataagttattttaaagagtttaaatccatgattgttcaaaataggttgttttattttcaatataatatggttcttaattgtaacattaatgaacactgaagacatttttaagattcatttatgtaaagtgatttgatgaagtaagctgacatttgatggacttagtggaagtttagacccaatttgcatttcagtggtattttatggctgactttagaaaactttttagataggatttctcggtaaattaaaggatttagagggatgattacgaaataattgattaaaaagtgtgcaatattggttttcattgaacttaagcttgtatgggttcaatttaaaacctaattcaatacattttagattttatatttccctgaacctcttctgctgtattaattttgtcatgcttgtcattctaatctaatgatgatttaatgtttgcaaacctgaataaatctgtatgcaaggagttttgctgtgtttttaatcaatgaagattgaaatttggcaactgaggtgataaaaaatgaaaaattttaaatagaaaatgaaaataatgattatactttagaaagtactcttattaatgttcttggctatgaaccatgtaatatttttctcttatttttatcgtgtaatattttgaaggtgactgaaccttaaaagaagtaattgccactaaatcgtgaagaatgtttaaattagaacagattctttgtcctcactgtcttcccctttccctgaaatctgtagtctagagttgtgaataagagccagaagaatgttaaactgccttttaaaaactcgtctaccctccccaagaacctacatagacaatagaatgttctgtaatgaaagtgtatctttacctcattatttatttattttattgagcaaaaaatgtagaacatagaatgtctaacggattagtcacaataaaaaaaatttcctgggttatatatgtaaggggcagcggctgctcctctatcagtccaggagagcctggtctgatttcacattgcttttctttccacatgatctcatgacactaaaagacgattaatacatcctttaaaaatcaatacgggacattttactgtagtccttcacctttattgttcagtacccttcaggggtgaaaggagatattccaatgcaaaaaatatgtctgaaaacctgagtggtaagtaataaaagtttttttttctcttaaaaagtcttataacattgttatttcccagatttgaggggtgggccttggggtggaattaaaaaatcagtgtaatcatttgtaaggacaaaatgcgagtttctataaagaatgttttagcataatgtcactaatgttttgcagtgtgtagagagcaaactttaaaaaaagatgtgaaaatttacaaaccagtaatcctctatttcatgtgccagcagtcaaaattacgtgtgatcggctgggtgcagtggctcacacttgtaatctcagagctttgggaagctgaggtgggaagattgcttgaggtcaggagtttgagatcagcctgggcaacagcaagaccccttctctacaaaaaataaagttagctggatgtgatggtgcgcgcctgtagtcccacctatttcagggggcagggctaggagtttcaggtttcagtgagctgtgatcgtgccactgcactccagcctgggtgacagagtcggatcctgtctctgccaaaaaattaataatactaaaaaaattagatatgattaaggataccaaaaaattattcagataccttagtggaagctttggctgaatagaagttccatcttttgtagtactgaaaccaagtgaagggattacgtagttgacatctctgaaagagagaacgcagtggtaatgagaatactccccctacgtttgtgtatgagccttggcagtttcttttacactctctcatttaatcctctaagacctgagacattgttggggcaagtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacggtgtctggcttcaatctggggctgtcacttagttggtgtgggacctctcatctctattgccaacccaagtttttgattctttctttcctcagtaaactcttaatctttctgtccttggaatcttctcctttcacttcaaacaactcatctgtctttatcctgaaaagtttatactttactaagttccatcattggcagcaaccctgttttcttcccctttgtattaatattttttttttttttttttttgagatggagtttcactcttgttgcccaggctggagtgcagtggtgcgatcttggctcactgcaacctctgcctcctgggttgaagtgattctcctgcctcagcctcccgagtagttgggattactgttgcctgctaccacgcccagctcacttttgtatttttagtagagatggggttttaccacgttggccaggctggtctcaaactcctgacctctcgtgatcagcctgcctcagcctcccaaagtgctgggattacaggtgtgaatcaccatgcccggcccccctttctattaattatccaacatctcaaatgtgcagttcatcacatttttggggtggtggttagacacaatatagttaacctatttagataaataaactcttttatttcccctgagtgaacatttcatctaaaacgtgtgtcgctttcttgcttaaaaaccaataaagctaatgtttctcaagtcatcatatatgagtagcatgcaagctccggatgcagctgttcctctagagactactgttgcgctccttacaagcctctagagcactagtgaagagtaatgttagattgtttcgggtttggtcaacctttcctaagactcagtggacagcaatcagttaatgtgccaagaagcataagctaaatccagattgcaacatactactcattctgaatctgtaagggaatgcctctgtgagtcactgttgtgggaatgtcctgggatggcatagttaatactttctaatgggatttaaaaagtcagtacatttctctttttgaatttgtttcttaatgatctgatgcacttttggataagatacagcttgctttatagaacagaaaaaacattgtcatttatacatgatttagctttatgatcatgatttaaagccaccagctttgtgggaggaagatagtgagaatggccatgacagctttaactacacccttgaagacctccttgcttactagagggcactgtgctgtcctcagatgccctgaggcaggtcagattgggataataattacattaactcccaaactaccctgtgctggactttttttttaagttatagctctatggagatataattgaaatatagtaaatgggaaatatttaagatatataatttgatatgctttgacatattcacagtagtcccctctcacctgcatattcatttttttgtagtttcagtcacctgtggtccgaaaacattaaatggaaatccggaagtaaataattcatcagttttaaattgtgcaccgtcctgagtagtgtgatggaatctcgcaccatcccttgtgccctgtaaaatgaaggtgtattccagagaacaaaggaaggatggagcttttatagagcatctttctgcccaggtttgcattcaggtatattttttcaaatgaaggagtccaccttgcttagttcaggttgctcagtgcaagtgatttctgattggttggtgcaggctatacagtctgttggttcaggtggcctgaacaggaatggtaagctgcgaaggttcggagttaaacagatgtgtaggttttctggaaacttggggtacatgtgtgaccattagactcagttagcccctcaggattcatcttgagggatttgctctttgaggttcacagtgatcagatcaactgttgcagtatctcagtgcttgtgttcaagtaacccttattttaattaataatgaccacaaagtataggagtagtgttgttggcaattaggatgtgccagagagaagatagaaagtgcttcctttaaatgaaaaggtgaacgttcttgacttaagaaggaaagagaaaaatatgctgaggttgctaagattaagaacaaatctatccatgaaattgtgaaacaggacaagtaaatttatgctggtcttgctgttgcacctcaaactgcaaaagttatggccacaatgtgtattaagtgcttagttaaggtggaaaggtaaatttgtgagtggaagatacgaaccaaaaagatgttccaattgacagcaatgtgttgtgccagaatcattcagcctatatgacgacttgagcaagggatcccttgaaatgagttacaccaagtgagggatagttacacagattcaagaatacagataatcagtagtagcctaatgctgcgtcacaatgcatacgtctttcaccctacttcatctcattacataggcattgtaccatgtcacatcattacaagaagaaaggtgagtatagtacagtgaaatattttgagacagcccatgttcacataactattattacagtatgttataattctattttattactagttattgttaatattttattttatgatttataaattaaactgtatcataggtaaatatgaataggaaaaaacagtatatatagggttcagtactatctggtttcaggcattgactggggcctttgaatgtatctcttgcagataaggaggactcttgtacatcatgacatgtgtggatccaaaatctcaaaaaaacaaaaaacaaacaaaaaaaaaccaaaatctctttttgtgtgtgtacatgaattgttccagcaccatttgttgaaaaggcttcccttccttcactgaattgcctattcactttcttggaaatcacttgtccatgtatgtgtggatctatttttggactctgttttgttccgttgatacatttgtgtctctttgcaaccactctattttgattgctgtcacttcatcataattcctgaagtcaggtatcattagcctcccaactttgttttcctttttagaaacagcttgttagtttctaccaaaagatatcctgagattttgactgggattgcattggatcttgtaaatcaatttgggtagaatagacatcttaacaacatcgagtcatttctgagtctctcacatgtaaaaccattatctgcgtttaaaatgtaaaccactcagtgtcaccgatcataaaccaaaagtgatacttagggtaccttgaaattacattaagcagaacactgggaattggtctttttgcttgatttgcctgagtgattctccacaaaatccccacttaatatgataggtatgaatacgggatgccttatccagagcagctctccacaagcatcctcacgccacagatgccagttgaccgttacgtgtactcacctagcctgctggtacctgccagatggtgggcattttgggtgagattatgatagatttaagccagaggttcaggaatatccacattctccaaaaaagaagattaagccattattattgggagcagcctaattctagttatgaaggaaagagatcagggtgccatatgtacttagatagccatgtcttttatagcacatagcctttcatgttaaagctccgcatttttctaaaggagtattgattatagtaaggaagccaaggttcaactcgtgtatgtgtcaggtagctggatcattcattaccaccataggtgacacccatgttgatcagttacataaagaccacaaatggaatggtaactgggtcattgcaaattaaccctttctgaaagacagttcaggacatatttatccttgagagtgagcctacactatcctcctaagacctctcttttaagtggagaatatacattttggaaacaaggttgtattgtggttgagggcatgaagtcaacctgcctgagttcaaatcaccactctgcccttttctaacttttcaaatttagggattcacttagtttctctaagcctattttctttgagaatatggaaaattattatagtaacatggggaaattaaaagtgagtaattgtacaagtttagtgcacttgatatgttttgtttttagcatattttctccatttttcctttttccttttgtgtgttcttgttgccagtgactacctgtgaaatgtaaactgttgagtgaactgcttttgctttactttctgtgaattacttgttctactcactgtgttctgtctcttccattccctccgaacacttttgatcttttcgttttgccccagtcttctttcatttaaaaactaatttctcccaagaagcctgctctataaaggatgtgtagattagatgaggtgtgggaagcatgtttacttataaagcaacacaataccctatccatatccagcctgtaaaaataaaaatctaagtgctttttttttttttccctcccaagtaaagagaaaagtttcagggttatatccttaacatgtaattaagagagttcaagatattttatgttctatatagcaatgcagagaatatttaataagcattaacaaaaaaacttaaccttgtggtagatagcattgtactaattaacagtttattttatttagctacaagaactatgtcagcatgagagctaacactacttatgtttgacaattttagaataggaataaggtaaaaatactcaacagagataatggtagcttgcaaaccgtttatgtcaaatatattaaaatttggaatagttgaagactagaatccaaattcaagagtaattaaccaaaatagttgacagatgtcagccatgctaataaaatttgtataccctgaatattttccagcttgtaattaactgcacagatgatgtgatctgattttgtcactaactgcttattaatgaaggagatgatgactagttacaaaatccatagtgctagctgaattccaagtttaaatgtttctcatacagccggcattaattggagccacactagcctccatgctggtttgatttgtgcttactttcttcatttgtaattgcgaaggggaaactgaatttgttaaattcagctctgagtgaccttgaagatagtaaatctgtttttatttggtggtcagcagcgtaatggcttttatttttagattctttcttataaatgtattgtcatcaggctagtgatatcaccattggaagttgtataataaagtgcaaactgattatttcaagttcagctaaaccacagcagaacatgatgtcaatatgactgaagatgtgaacacagagtgctattaacaaatggtttaataacaaaagagcattatttatttctatcatatacatagcacggaagcctgagaagaagcaaaaggattcaagagaggcggttgtgcagccttcctgcctgcgccagctctctcccagactcctatactgctcttccttctttaccttacgttgctgtttccctttttacttctttccctggaaagggcgggtttaattctgtccttatttataagacagagatgtttgctacctcctgagcccaagtctgccagctgttggccttcttctttgggtggtctccctggcagtgtggtcttacagtatttatgtctgcctgctagctggttttgcctgttggacatctccacttggatgtctaccagacatccccaacttccatgttcttagtgtcactttaattttcctttccccaaattattttctctaccgtagtctcttctttcttatttttgtatttctgtgtttaggagtgcttaatgaatatttattgagtcaatgggtgatttcatgatacaattatagtagcaggtagtactaaaaagaggaactattttctccttatttaagaactttttataagagaactctagtttttcaaaattctgtttaaaatgggccacccagaactggacacactcttctgttgttcgttagtgttcgccttagatggccccacctctctgtcccctctctctagctatgtatatttcttttcaacagtcagttgttagattgctgtccttgattggttttctgttttcagtaggccagtccccagctaaattgggtgaccaacttggctaatgtccagttttatctaaagtgatgttccctgtttgcacagatgactttttaaaatctcctgcaaatgtgatcccctttagagccctacctgcatggtttgaatagcctcagtagccaatttcacaaacaaaaatgtaaggtctatgtgatgtagagtaataagataagaaactatttcctacttacaaactactttgaaaaattttgaaagatgagtttaaaatgtttaaaacattggtaataccagcagagtcagtaggcatatttgtaggatacttagtataaattttggtgtatttattttcttaaaataaatcacagtgaaatcatattattgtatcttataaaatgccttactctgttgaaaaggcagatttatattaaaaacctactagctgcatttatattaaaattgttcaccttattaacaggtcaaacaatatattcttttaagaattcacattttaacacttgggtttcagctgataaaacttatatgcatttgggtataatcttagatacctacaaaacagcaccaagacaaaaatgggctcaataataatgagagagcaagtattttaaagaaaacagaatttactgacttttaccatggttaggttaagttaggttaaactgtggaaggaaattgtgctgtctctcccctaaaaagtttaagagcaaattatcatcttgaatggtttagttattcacatgactgaagttaggaaccattccttttaactttttattttgaaataattatagatgtgtaaggacttgcaaagatagtacagagagctctttgtgctcctcacctggttgctcctaatggatattgcttatataatttagtacacatcaaaatcagaaaactgacattggtacaatgtatatgtgtggttctatgtcattttatgaaccttccttgaactcttcttaccccacactgtttataactgtcttacatatttcttctacacacattaagaatcacattagacaatattatttttgtttcagccatcaaacataatttagaaaactcaagagaagacagtctattgtgtttacccatatttttgcttatgttttttcttccttcctttccttcctgatgttctaatattctcttatcacttttgtttttttcaactttctttacatattcttgagggtcggtctactggagacaaattctctttattatttcaactgagaatgtcttaatttttatcttcatttgccaaggataattttgctggatatagaatttgcagttgacagctcttttctttcagcccttgaaaaatgttctattgctcccttctggtcctctttagtttctaatgagaaattctgtcatttgagttggtttccctgttaggtaagatctcatttctttctcaagacatgctaataatcataagattggttattgtaattcaagcagctactatgtgcttggcatggtgtatgctgtctgtaaccttgaaaccctctattatctctattttgtggataaagaatctgaaactcatgcaagtacattaacttagctaaggtcacacaatttagaaatgtttgagttaaggtatgaaccaaggcttgtgtgcatctaaaatttttgcactttatcatacaattgcggaaagttggagacaatcttatagttgataagttttctaccagcatcttacagcaaaaattacaatttttctgccagtcctttctttgactttgagtagaatcttaaaaagacactgtgtaagagccacgaaacttccttgcagaagctgtatcatgctaaatgttttggatcaattcaactcaatttaataagtctctgcttttaatttcattttctcaccgtgcattataaaatagcatttgtagaataagttaataataattttaagcaatacctattttcaaacaagacaaaattattattctatttgaattcaatccctaacaaataactagtatcaaatcagtggtactgcaaagaatagttaatatccagggtattgttttagctgcaagtgtttgtggattactgaacagtcaagtgggtttgctttgagattattgctttcccatgtgtttattctcttcacagtctttttcagttgttgcctggttcatctttttagacatcatgtaattggtagaacaacagtcaagaaaaaggttgaaaaaaaatacagatgagttctctggagatacgatgaagcaatctgagtgaatcatgatgtgcagtgggctttaggtttctatttttgtgcaagggaccgattatagagctctgaacttgaaatcttattaaaatctctgaagatgcagtagaatacatctcatttaagaagtgttctctaagagatttataattcagtattgtttatatatgtcttagtatattagatattattcattaacctatattagaggagacaatattttacttaatattttcttaagttacaaaagtaaaataacttaatagtaacaattggaatgattaacatattgtgaagcgaaacttatctttaccctagctgattgtgtaccatctcttctcaaataatgtgatattaatctccaactgatgttaacattgtagggtgtatctcttcatactcttccccatgctcaaacaagtacacacacacactcacttactcttcacatgtgttggacttcaataataataaatgtatgcttcataaattggaccattcgctaagttgccccccaccccattcttctaggacagtatgtatagaacagaatcacttaaaattaactggagtgtattctatagtatgaatgtactaattaattcagttattgcatattgatgtacatttgggtggcttcctgtgaggtattgttttttgtttctgttataaacaatgagacggtaaatatcttagcttatatatcttttttttttttttttttttttgagatagagtttcactctcgttgcccaggctggagtgcaatggcatgatctcggctcaccgcaacctctgcctcccgggttcaagtgattctcctgcctcagcctctcgagtagctgggattataagcatgcgccaccatgcctggctaatttcgtatttttagtagagacagggtttctccatgttagtcaggctggtctcgaattcccgagctcaggtgatccacccacctcagcctcccacagtgctgggattgcaggtgtgagccactgcacccggcctatatatctttattcttacacaacaatgctttgatttccagagggtaggtttctgataatgggactgacagttcaagggatatgtatacttaacattgtatagatattagtagatttctttcctaaatgtttactgcagtcttgtataaggttcattttatcacatctttaacagcactaggtgttatcactctttaagcaaatgtgatcggtgaaaactgctatctcgttgctttaagttgcatttgctgaatattggtgaagttgaacggcttatgtttattggccatttcagttttgtcttgtgtgaatttctgctcatattatctggccatttttctattgagttgccttttacttaccagtttctgggagtagtttttatattagggatattaactgtttggttatttattttggaagttttcccagtctatgtatttttgaagtggtttagggtatttttttttgctctagaataaattaaaatatatgtaatcacattgatctatctttgtttaggttttccatcttagttctacaaatatttgcctaaattctcttatgaatgttactgtcttattttttatataaatatcttttaattcatctggattttacttctatatatggtgagatatgtgagtcaagctttgcatttttgtagatatctagccacttattatgctaatgccatttagtaaataaaccaccctttctttctgaatttaaatgccatcagtactttaaaaaaatatttaaatggttacatttttccccagcttaacccattttcagtaaggtaatgactttttaaaagcaggatttagtaagttgaaaaggttatttctctttgctcaaatgtcaaatgctacctgttactctttattgtttctggctaaaattgcgagcacaggaaggattattcctgcgaacaaattcactaatcagcttgcaacctaacaattttaagaccctggggaaaaaagggaaagtttgggatatttactcatttcttctgtaaaagcaataacatgtaaacatagtgaagaaaggcatttatggaatctaagaaggaaagctctttgcttttcacatacagagaaattaggattcattgagtcctttctttacaacataagctctgtaggaatggttctccaagtaaagctgtgtgtcacgttttggggctaggggtgcctcaaagctgcacctacagagagatctgaaggcaaattgccgatttcacacttttattttgggctcatcctttatgccctgcacagagcgatcagatccatacacatcttactttcattcattgtggaaataatgtcctcaggcttggtggtacaaaatcgtgctttctacagtcttctgctaggaaatgtttattggatttagctgccattatacaaatgatgaaggagaggcaaagtaactccagtatctctagccaggagtggcttgaagaattgtatcagttacagatttgagaagatttgactatatgttgaattaggttagatcatctttataattagaagtaggcttttggagtacaaagaattcttctgtaaacaccttgaatatttaacaggaaggccataaggaaatataatgtgctacattcctaggatagaataacatgcagctattaaatagcacattttgtgaatatttaatagtagcatttaaacccaaaagacactgagcggcagagacctgtgtaactagtttgttcgttcatttcttcattcagccaatatttactgaacatcagctgtgctttcagcattttgtgaggctctggggaataaagatgaagggtgtagtctttgccctcctatagcttaggagctagtggacactcaggttacatcattgcagaactgtttattaacaattagccacgtgtccaggatgccatgaaaacgtagaggggaacacacaaatcagactggctgttggggggtcgacgagacttcatggaagtggtcacatcggagctgcgctccagaggaagaaaggaattaaccaggcataaaggttgagggtggttggagggagaggagctttcaactaggggtgaatagtaaatatagacactgaagaaaaatggaaatgtgtgtggtaaagtccgttattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgtgagcaatgtcctaaatctagggatgggggagagggtgaaaatataggagaaaggggcaattgttgtgaagttccaagagacaagcccggagttccaggaaaaatagggaccgctttcccactgagtctggagagaggaaggaacgttttaggatttaaggcacaggcaagtttgaggtagggcagagtaggccagggaagaatgcgaatagctgcgtttttgtttgtgaattaaagggtacattctgaggaaatggagggaagagagagggtcaggggacttggacacggggaagggagctgccttgcactgaggcctctgcagatgatcacactgcatcaatgtgatcaaaatgacgtcagtgttatcagcagtagaatcagaaacaagtcgatttcatctaatttccattatctttcactatgtgagatatttttatcctgaggatttacatgtaacataggactgagtgatttactgaaatttaagctacagccaatatttgattaacaatacaggtatgaaattaaacagtactgtcggccaccaggggttctactctgcgtgatcactttccattttgctctccttcaaaacgtccacattttttctctcagtcataaacatttaaaaaccaactgtactgggccaatcaaactagtgtagtaagtgaaagacttagagaagtgtatgcaggtggtgttgggcaattgcaaagagactagcctccaaatgggagtgttagcatagcacgcaggcttctctccttatgagctctgactccaatattgactcttttttgtatacagaaaacataatctgttcagaactcattacagtgaaggaacttgtattttaaaaacagagatagagaactaaatttgtattgagttaaattgtataaattctttaaggatttcaagggtaagccgactcacatgattaaagtaagttatgagcatttttgtttatctgttcagtgtgtttggggcttttgtcgtgtcagctttctttaggacaggtagaattttatctaacctcttaagaacaagtggttattttctcaaggactctaggatggtgctagataccccagattcttaggtgctggctttatgtgttgcctttgctaagcacttggttgctttctgccactctttggaagcaggtgattgatactagaaactgacaggttgtgagtgatgtacccttccattaaaaacagatatactaatttgcttttcaattgtagagagcctcttactataaacatccctgtaataaaggtaaccttataattagtatgtcaaaaaagcaagaaagttatgatgaacatgcattaataacaaatcaaaacctttactaataaaatgtcacattgagaggacttaattttgtgtacactttcatactaatataaggcactcttgctaatagtgaaagatggaaatatttgccaaccagctatgttatagaagaacttcctacaatattgtcctatgtacggtgacatttagaattcaaggaaatatacatagtcattgactttgtgtggaatttccctcccctcctccaccaccctgttagaaatccccgctgttgactgtttccagaagtcttgcagggtgttgtgataagagtccaattcctcttcccattcctgcctaggtcatctctttcttccctccctccttttgttctgtgattctttgttttatttttcaccacagaacatacttcattatgctgcccctgttaaaatcagttaccctattccacctgattcatccttgagaaaactactcatggccattgtgggttttaatgccactgccatccccgtcttgccattgcctcctcagctctgtcctgctaccacgatagagtggaccctgtgtcacagcaccattggtacccatcctgccactggtgtctagaactttgagcagtttaaccccccccggttttccaactctttccctcaccaacttgtgaagcctctgaactggtatctgagcagagccagtgccttgcactgtgggagtttcctgtcctaatgcttaaacaatggctctagaacttggctgggcatgaggaacatcactggcttgtaagggatgcagagccctggtcccctgaataagttgccctggtgggccaaataatgttattcctcacatttggtatccacatcaaatccctggaacctgtgaatgtgaccatttggacaaagggtcttcgcagatgtaattaaattcaggatcttgagatgaagagattatcctggattatctggtggaccctaaatgccagtacaaatatccatatgagagagagacacagagggaggggaagaaaggagaggaggcactgtgactgcaggcagagattgcagtggcgaccacacaggaaggaatgccgacagctgcctactgtaagaggcaaggagcagatttccccttagagcctccagagggagagcagcctggaacttctgggctcaaaccatcctcttgccacagtctctccactcactggcactacaggtgcaccaccatgtctggctaattttttttttacttttcatagaaacagggtcttgctatattgcccaggctggtctcaagcgatcctcctggactcaaatgatctcctggactcaagtgatcctcctgccttggcagtattttttttaatggcactgagagacagtattatttcctcccggcacatttggattgactgttaagtaatcacattcatttcctgattttgatacaatgtacgactggttttgtaggagaaaaagaattgggaagttttaggaattagaagttatgtagatttttaaacattgagaactttgtcattttcattaaaaggctaacttttttgttataacttatttcctattcacagtacatcaccagctgcttttttacttatataaacttggacccgagatcaattggttgcctgcttactcattctataaaaatttggaggcaccatacagtaagaatacataaaaataatttacatcaaggaaaaccaggtccacaaataaaatcgatacagctagattatgaaaatcaactcactttctagagtttcatctttatcattcattttaatgttacgttttttcagttttcccatttaaaaatgaacttttattaatgcatttcgattttttcgtgttccccaagatttgtgtgtgtgtgtgtgtgtgtgtgtgtgtgtgtgtgctgtgtacatttaagtctatgcaattctgttacaggtgtgggtttgtgtttccacagtcaagatacaaaatagttgcattactgcaagagtcccttgggttgtcctttcataactatcccttcccaatctctgatcagctgcaataacacatttgttttccgtttctataatacggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaagtgtgtaattgctgggttgtatagtaattgtgttcagtattataagaaactgccaaactattttccagagtgactgtaccattttactatttcaccagtgcttgagtggtaccgtttctctgtatccttgcctgcatttggtgttatccttatttttttattttagatattctgataggtatgcagtgatatcttgtggctttaattcacatttttgtaatggctactggtgttggatatcatatgatatctgttcgtgtcatttgtccattttgtaattggatttttgttttttttttactgttgagttttaaaaatatatattctagatacttgttctttgctggatatgtgggttgcagatattttctctcagtctgtagcttgtctcttcatcatcttacgagggttttcacaaagcaaaattttaaattttgatagatctaatcaattttttctatatggatttgcttttagagtcaattctaagaactctttacctaccattagttcctgaagattttctttcctttttttttttttctaaaagttctatagttttaagcattacatataagtgactcatttcaagttcattttctataaatgtgagacttgggtggagattcatttttctttttaattgttcaatggatgcctattatgccagcactgtatgttgaaaagaccattcttgccctgaattgctttttcatccgtgtaaaaaattagctgggcatcttactgtgtgtctttctggcttctctactctgttccattgatctgtgtgactcttcctccaccgataccacacagttttgattatggagctatatggtaggccttagtattggatagagtgattcttctcactttattctctgtcaagattgttttagctattctaggttctttgccttttcatataaatttttaaatagtcttatctgtgtctgtaaaaaaactttgctgagattttgataggaattgtgttaagccaatagatcaatttggcgaggagttgacattctataaggtgacattctatgcatataagttgacattctatgcttagtcacaaattctttcagttttccttgtcttagaatgttcttatttgttgttcattcctcaagggtgatttcactgatgtagaattcatggttgacagtccttttctttcagcacttgaaaaatgtgttgaaaaccttctggtctccatggtttctgttgagaagtctgctattatttgaattgttattcctctataagtacagtgttgtttttctcactgatttcaagatctttttcttcagtttttattaatttgtcttgctatgtttttccttgagtttattttgtttgggcttcactcagcttcttgaatctgtagatttatgtcttttgctaaatttgggaaatatttagccatcatttctttaaatattctttcagccccagcaactttctcctctgcttttgaagctctactgacataaatgttggatcttttgcttttgtattacaggctctgaggttcagtcatttttctcccagtctgttttctctctgttgttgctggtcaattccattgctctatcttcaagttcactgattttatgctttgttatctgcattctcttattgagctcattcagtgagtttatctttcagttattgtatttttcagttctttaactttcatttgtttttaaaaaaataacttctagttctagatttttttgttttatttttttccgagagaatacatagttgcttgttgatgtatttttgtgatggctgctttaaaatccttgtcagataattccaacatatgtctcttcttggtgctggcatcagctgctagctttttctcactcaagttgtgattcccctaggtttggttgtgatgtgtgactttgaagtgtctcttggacattttggctgttatgttaggagactcttggtcctacttaaacctgttattttagctgacagcccccttagttaggtttagcactcaggttctggcctgcttttgtgggtggttccaatgagacctcaattttagagcgtttgtcttgctgtttgggtgtcttttgttcatctgctgccgataggactcccccgatccttgcaggtgcctctcaagggtgcacaaggtgcttccgcagtcctggctgcctgggaactttaatgggggaagggagtctggaaagaagtgcttctgaccactgttgtcagtgcggttctctgttgtccgcttttctggtgccactgtgcttacttgggtgtcgttactgggattctgtttggtccgggcaaggagtgagcctgccttagctgctgcctttggttgtttgtaggtcaggaaacacggggcctggtttgctttcttcccttaggtgaggttcataagatgccctgccattacgttgtcccttcagtcttggccttcctaaccagttagtttgcctctttccacctttcttcttgcaggaagaaaatttaacttttttttctgattcttgtgcctttcccgagccaatccccacagacactatacacaatgtcttcttatctccctttaccttcccactgtcacaacttgtggttcaatcataatgtggtgtgtacatccttatgactattaattattggtcatagctgacccatacagcatacgatgaggatagctcctctctttccaggtttctgttttgcctggttggattctatgtatttatgattagctcatctctaaactgtatgaatttcagcttaatatggccaaacttgttgactggcttattatttccttttccttttcttcctggagatcttcctctaagagctacacatcagtatgagctgattgttctctgggtcttccagacagctctcatcttggcacctcacaccaccaccttctccctgtctcctttgttgttaccctgattccttggactccatgtctctctctctttctggttttacttgtttattggagcacaccttctgggagtttcctgagaatgcatgtgtaagaagtaaatgtttagacacttttgatctttggaaatgtctatattttactctcacacttgtctaggtaaaaagttcttggttgaaaaccattttccttgagaattttatattgccctttgccttatagcctccagtgattctcttgacaatggaagtgacacttggattcttttttgtgtgtgtgtgtttttccctgttggaatactcttacttgtctttttctttgatggtttgaaattttgcattgatattcgttgatgtggcatggtggccttgatctgggtcttggtgggttatttaatctggaaactaatgtttttcttttgtgggaagatatattattttcccagaaagaagtaataaaattatttctttcccctgttgtctctcttttctctttctgaaattcatttaggatataagctctaaaagtagagggatttttgtctatcctaagtgcctagagcactgtttccatagagtaggtccatataatacatgtattgcacagatgaataaatgaactccttctatgtggctgttaagtctcctggatttatcttcaaatttgtttccctcttttattgctcagttctttttcaggccatctacccccttttttcttcagaatttttttttttgtacttttttgtaccttttctaaggtaacagttgtggcaagaaacagaaccatctacaagtatacaacctacctggaatggatttttacaattccagagtaggaggtagatagaggtcatgatttattgttttctatataaatgtctgtttgatgcagcatcattataattaacataatcatcctttctccagtgcagcgcagtgtcacctttgtcctaaattgagtgactttgtaggactctttctacttgctccaggaaatacagattacgtttcattggtctgttttgtctacctatgcaccattatcaccgtatcttaattaccgtagttttacaaatagtctttatgtttggtaatgaaagtgctctaaattcattgttcaggattgtcttgatcattatttaatgggggaaagagttttaagtttccatgtaaagtttccatgtaaacttgtagaatcaattgtcaaatgacatacacgtaaacacagaccaaaaaactctgctcagatttcgaatgagattgcattaaatctatagattgacctgggacaattgacatcattatagtattgtatcttctaacctatgatttttgtgtattctttttgttgtaactcttgcattttatctgaaattgcatgagaagttttgtctattctttgaagtaccttgttcatttcataggaatttggtactgtatttgtagtacctttttatactcctctttatgtaaggtatgctttcagttgtcatactttttgtatggctcatcacttttaaatgttgctggtttcaaaagacttgaaatgcacaaatcgtttgctgtttatgtattagtttttaacattatctgatgttgacaggcagtcgatatagtgctggatgtagccactccccagtgccatgaagaacccagtttctgcctgcctttctgcttctccttccttaatgtgttaatttttgttctgtgcttttgccttatagttgaagcatcactttcctgtttcaagaaggaagtggggaggaggacaaagggacaaaggagatgtctgtagaatgtattggctctcttttttaaaatcagggaagaaaatgcttttctaagtccccaccccataaattgcttcgtcgcatattgttgggaagaccttggtcacatgaacctcctggtcgatcatgaatcaagggtagtgagatggctccacttggtttagaccagttgtgatccatgtccttggcctggggtaggggccttcccttcctctccagtactgtttgaactgattgggattccttgaatagaaaaggagagagaaataatgtgtaggtaagagaaggtatctctcgtgtttattgaggcttttcaatatgtaatttgcttttaattttaagaaacttgcctgcctcttggatagcaaagaaagtgatttttatttgtattggtcttgcttttgccaaacattttaaaattaagtgatttggggataagtatttattttgaagtctattttattgtttattaagatatatttcaaagtggtataataaatgacattattattttcataaactattgcttcctgaagtgtttcaagccaaataaacatttatctttttgatgggaaaatgctttctaaatttccctcagccaagttatagaatggagccaactgcagtacatgtgggtcacaacctgcttgccatagttgtattctgggatgattgattaatttatgcctttcataaggatgctctgagaaagaaatgagtgagaagatttaattactgaattattaacttttaggagctccactttggaatgtgagtcaatatctattacagactgtacgtgtttatgctattgaaaatatgaattaagaattgtctttggttatttgacaactcaaaagattttataactttttgtgcagcttaaaaaggaatttagaaatgtacttttagaagggaaggaattcggataatttatatgtcagtgtgtcataataatttatttacaccaaaatctcattcacagattccagatttaatgacctgaatcttgccatttcttttctttaggcctacccttattttataggttctataaaataatcggaaaggaattagaaatagttttgtgtgtggtgtcaagtggctttgtttaatcattgggaatgaatcagttaaaaacttattttggggctaaaaacagccagcccaattgttataaattggagaatgaatgaatatgaaaatctacttacagaaaccattttaggttattcatatttcctgcttgctctgtttcttgtcatttggtattttaaaaataagtcttagactagattcttgactaaatagcaacctttttatctttgacagagacacgtttcttacattataaaaacatgaacattcaagaataaatcacagccaacttgaggaccatacatatctgacttggaaatttgctaatatatacagatttaacgggattttacacattttcgtgtttttgagggcttgtaaggtttcagtttgattctcatatatgatggttgatgtgttgtacaaaccaattaggagagcaatctagcaatcccttgttgagttagaagtgtgcagaccctaggacccagcatttaccttaggcggtcttactgttgttgcatcttggctttgtctagtttctcttgattcctgtccatttttggaaccttgttttctagtcactgtgacaattctgtgagcgacatggtctgtttcccataaattctttgtctgtttgatatagctgaagttgtattacttcaaaccgtaactctgagtggtataacaaagatatcaaattttagataacacccacatcttcctgagcatcgtgtgattttagtagctagaatttctttgtacagaagtcattgtggagggaaatgatgtgaagaaaagaaagaaaatcctgagaacagagcaacagttgctgtggagtggcgtgagggccgaattcaagtataaaaatctggattagaatcctccggtcacttagtagttgtgtgactttggtcattgttgaactgttgtgaggtttccttttcagatcaaaactttcccttttccttctctcattcccatcttttcaacagatgacatcaccttatatgttacagagaaacagaagccattagatggaaaaaacctcaatatccaacttacagaaatgactgacctgcatttatcttcagcatttcctccttttattaaatatctgaggtcagtatctccacttgggttttgagttccatctttttctgtcttcctagggaacatgtactatcaatttatcttttccctttcttgaatacccaacttgttgctcttaaccagatcagtttcatcggcatttaagcatgttcaagactcttctgtattaaaaaagaaccacgacctcccctaacccttccctaatctaactactgcaccctacctcttctctttgcatttacagcaaagctcccggaaagagttgtctgctcgctgcctcagcccacacctttttcatgtggtttccgcttctgtcattctatcagaattgctctgcagaggctgatcagtgacttcagtgaaaccaggcctaaaggatgctcttcagttcacatctcactcctcagcagcattcttcaccgcttgccgctctatcgttttgaaatacctgtaacaagcatgctgccttggtttccctcctaaatgacctctgctccctctcctctcaatatctttctctcttcccccctgccccgccgaggttgagtatcattataatatcattgtctacctattattgaatgttagcatttcccaaagctagacctagttctgttccattctcaacctacaatcttttcctaagctatttcattcatgtacatagtttgaattgtccttttatgtaatattatagatgattcaaaaatttatctgagctcccatcacgtctatctacctgttaacttgatatttctacttatatctttctaagccatctcaaactcaactcgaactagaccaaacttacctatctacctagtccagctgtaccataaactttgatgccttattcttcttgatgcctcatccacattaactccacttatcaccatattttcacctcaaacacctctgtgatctctcccctcctctctctattgccgccatcctaatgcaagctgtcatcatctctttcttggccaactgtagtagatgtagtctcatccattgtggttctttctagtctgtctgggactcatgacatcgtgcttttgggaaacagaagtgatatcatgttacccccaccaggttatccttgcttgccttctcattgctgtaaggataaagaccacagaccctcacatggattttacctccctgggctaccccatttggcagctcccccgtgtgttctcccttcctttcctctgagaggtgaattgtgccttgttccctcctgctatggggctttgcacttgtttcttgcccttccttcatcaacttgttatctaactctatcctgtgctttagatcttaacacaagtgtcatttccctgactccatggagatggggtcgagatttgtaggctttgcttattcttcatagtcctttaggtttacatttaattttgtgaggatttgattaatatctcagtaaccatgatagcaagaatatctttttgtttttgtttttgttttttcaccattttaactttggtgctgaaaaatacttgtcatatagttaggactcacatattcatgaatgaatgaatgaatgaatgaatgaatgaacatagattgagttttgagccctgcacttaacacgttctttttgtgtgaccttggacaagcttttatagaggtcagttttgctaaaagccttgcttcctcacctgttaaatagggataataattatatacaataatataattgaatgaaaagtgcataatttagtgccagtaaatgggatcatttagccatgggatcatggctttcactactggagtatttacaacttctgttttgctaaagtaggtgagttttctgtgcctatttaaactactttatatccctcaggaaaaaacgatggagccagggcttaggccttgtgaggagcctcattcatttccccctctctgctggtctcactccttgaatgctggtctctccatacatttctctgccttagtgtctgatggcttttaacatgttccctccaggacaggccataggaggagggtctaatgcaatggtgactttggaacctgaattggcttcttggacacattccaggcataagggccccaaagttcttttgttctgccttaggcatgtgtaacctcagggctttttctcccagctctggagcttcattacccagaggaccaggcagatgtcaaatgtttctcttacagttcatttatatttctctgatagctttaatctaaaaataatcaaaatcgttgtatatttttactgtgacttaaccaattgtaaaaattattctaaaaatacgcagttatttctgagaacaattacactgacgcatcgttccctgagtgaaacctatacatacatgttccaagtatatgaagcagttttttggggacagagtaacttttttttcccctctgttgaaataaggtattgggccaggcatggtggctcacgcctataatcctaacactttcggaggccaaggcgggaacattgcttgaggccgggagttctaggccagcctgagtaacatagcaagaccccatctttacaaaaatttaaaaattggcccagtgtagtggcatgcctgtagccccagctacacaggagactgaggtgggaggatcatttgagccgaagggctcaaggctacagtgaactacgatttcgccactgcactccagcctgggtgatagagtgagaccctgtctctaaaaatacaaaggtattaaagttaacacttgaaatgcctttcattctgtcagtggctctttttttgtttgtttttgagaaaagctgttttttcaagtcaacatttaaaacaaggataataaatgaagcatgaagcaaatatgtataatacattattcccgttcattgtgtatgtatgtatatatatatatatatacacacacacacatataaagtactttggcagaaatatatttcaattttgacttatttttcagttcagtttaacaggacacactaatgtcgggacagtctttaaaaatttggacaaatttttaaagagtaagttgtgacaatgatattacatgttaaatttgtccttgggaaacatagacatttatgtgattttttttccctttagtatttgacatcaaactatagcttccactgagtagttttaaaataatgtacttcgtgctgctaaggctaacattgttgctaaccagaggaaccacagaggaagacttttgaaagagagggcacaaactcttacagatgtcaagagtcagaatttacatgtggtggggctaatccgtaagtgagattaccgttagggagctccttgacgcaaattggcattgtgcctgcacttccgtgtgacaagtgggattctcagggtgagccctagagtgtgctttttgacttgtagcatctctggattctgggctcaagcagaggccctcctgcccagttggccaactgcgacaatgaatggtatcgtctagaggtcatcataattctccccagcatttccataacacatacaaattaaactatgagtaaaaaaatacttaaaccaaaaataaaaatgagaagaaataggcatatgaaacataatgagtaacgtcagcataatttgagattttggcaatggaagactgaagttgagaagtgtttccactagggatactctcttgtgcctcacattagtgtgtcctgttatttaatacccacagaagcttccttttcttccttgaatggctttgcactgctctcattgctaggttcatatactgttgggtgatgggtgggatcaagtcccctgtgtgctgtgaacacacgcatcctgattcaccactttactgagggtgggaaatgacagaggttgggcctgtgttctcttgtcacctccgtatatgatcattcaggcgcgtgtctgggaaggtgtgaaggagtgtcctgtcagccagttgagaccactgtgttggtgttctctgaatggctttgcagcctatgatggagtactttagggagtcaccttttgggttggccatcagtctaacactccaagcagccatagggacgtgcagaggataaattcatataaactacacctaaggcgttcacacatggtccaagttgtctgtgaataaaaagtgttgctgtaattttccatcactctttttgtttgtttgtttttctggagtgataaagatggacatggaaccctttgaatggtgcttcaggaggggctggtttttctcttctcagatgggcaactcagctaggggaggtgaggttttgttacaggatatgccttgactactaccatgtggagcaggactgctggacatgttgccagccatgaccgagcacctgaaaaccctgtgggaaactacctgcctttcatcgagttattggaatagggagagccttaggagtcctaaggcagattttcagctttatatgctagttctgggagccgtgttctgcaggctctgccaaaagactttgacctcacaagtgagatgttccatcctgaagtcctggatgctgcttctcaaaacattaataggaagcgtgacatcaagccatgctggctctctgaagttggagaaatgctgcatgctcacttggctaacaaggtgaacattactctgtcaccacatttttatctagtatgcgtcctaatctcaaggatccagctaagttgtgtgttgtcagttggagacattagcttgggcagtaagctcagccttgcactgcttctggcaggtttactcatcttcatccactcttatctcgatatgaggatatctgttttttgagcatgttccatatccatgtttcatgtgaaattgcttgtcattcttgcttatcacttaaaataataactggctcccttcttttgtagcatttgctaatagtggcagaactatttatacgattatgataatctgtcaagaggattatgcaaagtatctccccccaccccttctctaaagcagagttaaattgaacactgtaaaggacattttcataaccaaggatttttaccaattatttactgtggatttaaattgatactgaatgactggaggcattgatttttaaagctggaaatatttacaaaccatccaattctttttccttagtattttgtctctagttacttcgaaatctctctcctctctctctctacacacacacacacacacacacacacacacacacacacacacacacacacagagatgtaaaacatacacatagaaagactttaaggaaagacatcaaaatggtaaaagtcattatacctggttggttgaattgaagttattttatacttctttatacttgctttcttcatggggaaagtatttttatgatcaataaaaatatttttctgtaatatgtatgtactactttacaatattaaagcactttcacatttttccaaaaattaaaagcacagtgaaatttgcacattgagaaacatttggagccaattaaatgccacttatgtttctctaaaaaaaaggaaactacttttattcatgtaattaagagccccactcatgaacattaaagaattgttgcccactgtacttttggtatatgtagaaatataaaaccaaaaatgtatagtataaaaataaaaaatatacaaaaagtaaaaatataccaataacccagtaaaacaggattttgattggtatttggagaaattagctagatgtttatctgaatagattttttttgctttttagatatttaataattatagtaaattattttaaagtcagtatctgtactaaagtatgatagaagttggaatttatgttttgcagctattaaattttcttaagaacaaagtttgtttaaaccttacattcaatttcttcgtttgtgatttctttccatagtttctttgtattacaaattgagataaaattaaaggtaaacttaatttttttagtaaagcatttgtgattggatagtgttcaattaaaatttgttctctaaatggaaatttagtctttttcccttagcattagactttattagcttgtttgctgataaatgcttggaggaatctgaaaatgcatcacaagtttattagagatcttttatgtagttattaggttttctggctttctaattatcatatataggtgatgtaatcattgttgtcatgtttttttaatgaagattttaaatcgttttccactgtagacatttataatgtaatctatgcaagaaatgaatatttatctcagtattttaaaatggaaaaaataaagcagagagaaatcataaagcagagagaaatcattcatttcagttgtgaaaagttcagagatatgtttgacattcctttagtcttaactgcatctgttattcatgcttttctagataactgtataatattttcttttactactaatgaaatgtgattctctcatgtccagtgatgtgttttctgaaatgatataaacaaaaagtggttaatatgattttattaactgtgttgggactcagaaaatatcccaaaatgaaggcctcagaagaagccttagaagcaaggctttctctgaccttctcctgccctcctgtctcagtcgcattctcccccgaatctacccatagaaactagaatttgtcttccccaaggcagatcatagaaaccagaacccctttccccatagccagccataaaacctaaaagtattactctaacttttcctctgcctctctgtgtaaaaactagccagaagaacattgtctgacctacggtgtttgactgtaggtcataacaccctcattccagagagtgtcctcccttatacccagaaggaaggagtattgaatacatgcccagagaggccaggaagaatcctgctgggtttccgaactcagtctgttagcattagatcgtactgtctctgttcaatagtatttcttgagtgttgtccgtattttgttaatcttaagcataaaagtggacaacttccctagtatctttgggtcttcattatgaaggcctctgtgtacacgttaataaattgggatgcgatttctcctattcattgtcctctcatcagtgatttttagcataccttcagagggtgaagggggtaggtttcccttgactcctacaacttttaacacaatttaggtatttccctaattgctgaagttaccatatgaaatattcttattaacaacgtgttaggcttaaaggccagtttttgctgatcatgtcattatgtactggctgattttatttatttatttttagagaccagagtctgttgtgatttgaaatttcgaatttcgtgtcaattatgtaattccatcagaaattccccaaaggacacacctgtaatcccagcaccttgggaggccaaggtgggagaattgcttcaagccagaagttcgagaccagcctgggaaagaaagcaaggccctttctctacaaaaaataaaacaaatgaaacattagtcaggggtggtagcacacacttgtcgtcccagatacttgggaggctgaggcaggaggattgcttgagcccaggagttcaaggctgaagtgagccatgattgtgccactgtactccagcctgggtgacagcaagaccttgtctcttaaaaataaataagaaattccttggaaggaattaagacctgcagtaaatagcatgaggtgatgtacacttctttagtatttcttaatatttgcagagagcttgtctaaattgtgacttagttttccggttagggcctattcctaggttgtttttgcaaagaaagtttttgtgtatgtatgcctagcttttccttatccaatgacctttgtaaagactttgtattctccatctaacgtctagttacttaaggattttctgagcagtttgcttgaagtctgtttttccttcctagccattgacagaaaacacatctgccttagtgaggcccctttgatcttcagagagctttatctaaagagagattaagaataaatctgtcaggcattttcccaaagaaattgaaaatgcttcctaagatttcagatcaggtaggtaaagtgtttctctgaattaagacatacgaaaataagtatgctagtcaatggtttcatcctaagttatagattgcagagatttgcttctggcatgaaggaatattttttatttcacccgagacacaaaatgcatgcagtaatatcaatggccagaagcaactgcttttctttcattcatttttccatatttaacactagcagggtctgtggagaagatactagagagggtccatttgttctcagcctttttggggcttagcatcacaggaagaattttcagctggtctagtttgaatctacatactaaaaatttccaagatccatatgccaacctcctttctcccttcttctctccctcctttaaacaaatatgcacagaatgcttattttctaccaaactctgggttcatactatttactaggagcaaacctaacagataggtataggatctgatacactgtgtgcctcagagatagtcaaggtactaccctgaaaacgtgtacaactatttaaagatctcatgaacaccctcagttttagtatagaaatataaaatttgtaatcaaacaatttaatttttgatacactattttgaccttttaaagagttacagctaagaacagctaatgagctgttaatttagaaaataaaatatatacagaagtctgctttgaggttcttagtcagtaagaaaaccttggggagagaggttaaactaggtacgctggagacttattatgactttggcagtatgaaaggacaggaaacaaaaggaaaatcttacaaagagttatagtctgatttctgaaatgaatgtttacttgaaaggacacagaaaatagggtgccagcaggagaatccagttttccaaattccttttccgaaatcccaggctttttatgaaattttgagagaatggcttaggcttatgttttccattttgagctgcttagaagcaaatatcatataaatgcaaatttctactattatcatttactcaccttgtattatgtgcttaaggagttggagaattcagaagctgtttaatatacaaggcattgcctataaaatatttctttgtgacataatttgcttatttgataaacaagtatctttctttcctcctccttataaacaccccaaattagtttctgagttgaccaacaagattccatcagcatctggcaattattttatctgtttgaggactattggtatatgggacatgagttgctattatttggtaacattttgatgtccttcatttccttaattagtttaggaaaactatttggattttatgtacaagtgcttgctaattacttgagtcgtgagaagactgagtgaggtccaagtgtcctattaatccctttgagtctgaacattttcttataattggtttggcaagaggaataagtgagactagttgctaatgaggagataagtatgtaattttaccatgatataaagctgtgattgtcagtaagtggtattaggaatctagattatttttattagaacttatttctttctgcaaaatcattatcatctcctgatattgtaaattgggttatttcacaccattatttttaatatgtgttaatcctcaaactacaggtacttaaaaccttgctaattaaggagtcattaataaagttagcaatatgagccgtcagtttcgattcttcacaccatttagacgcaattcaattttgcgtatttacactatgttttcagtttggctcagatgtttgaagtaagtcaagagtaagaagtgttgtcaacttcagatccataggccagcttagcttgttttcaagatgaaggactgataacattgtaaagaaacagagaaaatactgcttttcttagccaagaacagagtaagctttgtatggttttactttttatagtctactcggcttttctgttcttaaaagttgcctggttatagtagtttaaaacactctttgggactttatccattgaacttcaatgttctctgaaacaaatattgaagtgttttgcatttgattttgaggaaaggtttattttccttttgaaaataatcaaactctttaagttgttcctaaccatagtcacttttacttgaaggatgcattatagtcttgagcattttttcacttttgtaatcggtatgaccctcttgtgtttttgctgatgagatggtagcagtgctgtggtattgtttgcaggtcctttcttatcctttatctgtgtctccttcccactgtgttgtgggttggtaaatgcatagttccctccattactttttcatggctgaagggattgtaaatattgttttgcatttctagtttttttagatgtccatagaattccatctttagccatagtgcttttataattttgtaatacctttgactagctggggagggggtatagataacagtttagtttccacatattactcattttgtgcaattttattgtgcttctgatatatgcccagtatgctattaggtgctgtgaaggaaatggaaaaaaaattagtaatttttcctgcctgaagaggtttacgatctaattagagggacaaggctaactaaaaagttagaaaacaatacatggtgaagataatgtgttaagatatgttttaaaagaacaaatttatgagattattatgggtgtatcttaatagaataattataactgataatagctggttctacatttaggtaaaaatgattacttccctatgtcaaggcctgaaatacacaggatgttacattttgaattttaaaacaaatcagtatctcattaaactttatggaacaccatgaaactttcaaaatttagaactttaacctagattactgaatttgcatttgaagacactgaggccagtgacgtcctggagtttcaggtctggctaacagtaccagcatgagaacatagggtaacagcaagttgcttgccgtagttttaggtctggcttacagtaccagcatgagaacatggggtaacagtcaggggcttctgagtagttggccgcaggaggtaaagctagtaagcactgctaacataataaaatgaaaggcattgcacacagaccagtggtctgctatttgaccctttcccttcctcctcttctttttccccattttccttttgctgctcttcttccgccatcatcatcagcatcctgacatttgcatggcttcttacgattttgaaattgttttcatatgtacacatttaccggagcatcacaacagccttgtgaggaaggtcagcattgactctgattgaagatgagaaaacacacctgcaaaccagtgaactaatttacaagagtaaatggagcaggacctcaaacccaaatttcctactccaagcctttcactgtacacactgcctcttagaaggctggttccaccccaaatcctttcccaaactggggaatcaattagaagaacaggtagaaaacaaggagtgaagttgtgttcaaatgcttacaataattacttggcttgtaccttttaaaatactttatagatttacttcttcaataatccttgtagatgtgtgtttagtgtattgttaggaattgtatagcatttacaaaagtctaggctggtttaaaccagtagtttgtggagcttttaaaccctgagagaccagcctctagataggactcttgcagtatgtgggacgttggctgtcctaaatgacctccaaaaaggccttttaaatctactccttgcttccatgtgctttattcatgactaccttttatttcctgggtccaggtactaatacatcttgaattatttttttttttccattttatctttctagttaccttccttctacttcttgctgctgcctcctacacagagccctggctcccacagtaggttaatatgtgtaataatgttcagggagtgtgatgaacatgagctgaaaattttagaccaccgtatggtctgcctatatttttctaatttttttttcctctccaaattcgcgtatgttcctagctaccacagcagtgaagggtagtggaaggaatgtggactttggagcccaaatagtttgggctgaaagaccaatcctttcaggctcaaatgcctcgatatttttggacatccacctttaacctgtaaaatgagggtagctgcctgccatgtggtatcatgcgcctgtccctttacctgtcaacttgacatctctaccagatggtgtttttttttttttttttttttttttttttttgagaccgtgtctctctgttgcccaggctggggcgcggtggctcaatctcggctcactgcaacctctgcctcctgggttcaaacagttctcctgcctcagcctcccaagtagtggtggcgtgcgccaccacgaccagctaatttttgtatttttagtagagacggggtttcaccatgttggccaggatggtctcggtctcttgacctcgttgtccgcctgcctcagcctcccaaagtgctgggattacaggtgtgagctactgtgcccggccatctctaccagatgttttaaagacacctcacatccctcctgtccagtaccaaccccagtatctcaccactcagtctctccctccagtcccttggcctacccttgacatgttcattgttctttaattcctttaacagtcttctatcacattggacgtttacctctccctcacactttgtgtcttacctgttaccgtcttgccacctctacttcctacatttctctgtaacccatccatgtctttccacctctaatgtcatcatattcaaattattgccatctcgcacctgggtcattacttctatttttattttttgagacagggtcttactctgtcacccaggctgcagtgcagtggcatgatcatagctcactgcaggctggaactcctgggttcaagcgatcttcctaccacaacctcttcaatggtggggactatataggtgtgcaccatcatacctggctaatgttttaatttttgtagagacagggtctccttatgttgtccaagctggtattgaactcctgggctcaagtgagcctccttcctggcctaccaaaattctggaattgcaggtgtgagccaccgtgtccagccctgacccattgtatcatcctaactgatacccctgcattcacttggtactctcccgtccattttccacatggcaaccaggatgataattttaaaacacatttaatcatgatatcctcttgcttaaagctctttgattccttccccttgttccattctctcccttatgtagaagctgatgactagttagttccagggtctggaacctgaactctccctcctgctctttagtgtcacttgcttcttgttgtcttcaaggcctggcccttccttggatacttgttctcccctctgtctggaagtgctgcttcttgctctctggagccctccccagccctgccccttaactgccccacctattcgcactggttcatagcagctcattctccagtcttcctcctttgagccccctcgggtgtggggctcctccagagcagcgtttccacccttggagcacgtctctctcacttggtgctgcgatgacttgatttcgcaaaaatcaagcaggacaaaggagatgcttcacatcctagttttctttttcctctaacgtcttttctaattgtgaagtttattttgattattaatgtttcattggaaagaaattatttctcattgattgtataaaaatcaaatgacatgattatgttatggccaggttttccccctccagatgaaagtccaggggagaatggtattaaaagtaaataaatttacttaactctcaagtcaagatttatgaatcattgactcaaaagaatgaagtatattatatttgtacaagacagtcttccacagatgcacggtttcatagtggaactgcatttaaaaatcacctgagctgcctctctggctctctgtggcatcatgtggtacttcttattcattgcgacatgggattcctgcccaaaccattaattaaacattttgactttccctttaaaattctgttagcatttagtagctttaatttagttttaaatgctgtttatacttcctgcttattatcttttggtaattaaaacttttcctattcatcatcaaaaagtctgtatttttaaaacccatattttaaaactcaatttaaaacctattttcaaacaatttctctctgttttagattaagtgactaattttctttatattccgtttcactcatgaaaggttttggagagcttcctaaaaggtacgatatgcatatgaaaactgttcctgtgctcttactcttctgatctgctttcaccttttatggctttctttaatgccagtgacttgaacattacacaggattccatcacccacagctgtttgctgtttatacatagacaatatttttcagttgccgttaccgctcctggtcgcatctaacactaccagggctatgtcttcagcaaaaggtgagtggtagttccagtacttcttttcctttaaccagacattactttttcctagattattatgccattgttctcattgtaatctatttctacatttctgccgaatgatacaacttagtgaaatcttctaataccttattaccaaaaagtttggggtcatataggactttatcattattttgtttcagaatacatatgtgttttctacctatgccattgttttttgattctgttaatggtggatttattttatatgttgaaatttagtatttttatatagttaattttgtcagtcactttgtagtgaacttttccaacctcgaattttttcctctgtaaccgttcactgaggctggagtttggtttggatgacctcatccccaggcccagcgattgaccctagtcatacacccagcaaggtggctgactgggaactcaggcctaatctaactagcgggtggtattcgtgactattaagagatgggtgtataactagggcttttggcagtaagtggggaaagaggaactcctctaactggtgaggcatgcaggcctaaggacggagactctgtaggcgtgagggaagccatatggctgaagaagctagcatgtgcaagaagagggcagatttgagagaatggcagagaaatggaacaagactgatcaaatgagtctgattgtgaccttcctctgtactttggaattacatgagccattaaagtacttccttgtttaagctagttgagatttcctatttgtagcttgaaatatcctaacacttcatttttgctttatggttttctccttttttttttttttttttttttttgagccagagtcttgctctgtcgctcaggctggagtgcagcggcgcgatcttggctcagtgcagtctccatctcctggcttcaagccattctcctgcctcagcctcctgagtagctgggattacaggcgtgcgccaccacacctggtgaatttttgtatttttagtagagatggggtttcaccttgttggccaggctggtcttgaactcccgacctcaggtgatccactttggcctcccaaagtgttgggattacacgtgtgagccaccctgctcggcctatggttttgtttctttcttttttctttttttttttttaagagatgggggtctcactctgtccaccaggctggagtgcagtggtgcagtcatagctcgctgcaacctcaaactcttgggcttaagggattctcctgcctcagcctccttagtagctgggacttcagcacacactaccacacccagctaatttttaatttttttgtggagatagagtcccactatgttgttcaggcttgtcccgaacctctagcttaaagtgaacctcccacctcagactcccaaagcacagggattacaggtgtgaggtaccacacctggcctgctttatggttttttatatataaaacgtatcatgagaagttggatggaaattttatctgtatttcctcttactgatttgttcgtttcacaggtgtttgaatccttacatacagtgttttgtcctatggtgtgtgttagagatctgcctttactttttttcctaaacagtttcccatatgtattgaattatatccttcctattgatttgcaacatactccttaggaaactttaggctgttggtgaattttctgttttgttccactaatctgtctttaaatcactgtatcagtaaaaaattataaagtattatccttttgtaatatattttaatgttttcagggaaaatatccctcattattttcctgaagtttcatggccattacctcccctttattctttgggattaatttgggagttattttatgttttatgaaataacttcttggagttttgattagaagtttataaattttataaatgatgagagtgttgacttattttttgagatagattcactccatcccttttaatgtattttaggcataatatattattagtgctcttataaatgagagcttcattttcttatttttcaatttggggaaaatttttgagaacataactatggtaattattagaaaaataacctaggagtatcatatttacatattctctttaaatatattcaactttaaaaataactttatttttaaagttgcatattcagttatcacaaattttatgtgtatctataagtctttttgcatttgtgtgggcctttttctttgttcttgatcaatgttgctggaggtttattgattttattagactttccaaagaatcaaaggttttattgaattattgaatctttatttatttttgctcttttattatttccttgattctacctgattcatgtttatactgtcgttcctttcctaattgttaaatttgttgaatttgatgcttagcttgtttattttcagcctatattcttttatcatttgaacatttaaatgtgtacgtttttttctaatcacttgctgcttagttccaatatatggtgtttttattatttttcatgtatactttagctttatgatttcttctttaatcagtggattatttagaaatgtgtttttatgtgaaaaatgtcataatgttttttgaaatactgatttctaacttgattgcattgtgcttagaggacttgaggtgtattaaactgattgtttagaacttgttgagactgacttcatggtccagtatgtggtcacttttcataaatgtttcacatttgcataagcatatctattgttcaggctgggtgtggcagctcacacctgttgtaatcctagcactttgggaggctgaggagggcggatcacttgaggtcaggagttcgagaccatcctggccaacgtggcaaaaccccgtctctaccaaaaacataaaaattagccaggcctggtggtgtgtgcctgtagtcccagctacttgggaggctgaggcaggagaatcgattgaacccgggaggtagaggttgcagtgagccgatattgtgccactgcactccagcctgggtgacagggtgagactgtgtctcaaaaaaaaaaaaaaaaaaaaaaagaatatctattgtccaattggtggatacagggctctaaaaatatctgttaatcatattgtctaaattgtcaatatatttaatgattgtttttgctctgattagcaattagtgagatatgttaaaattacttcactaaggccaggcatggtggctcacgcctgtaatcccagcactttgggaggtcgaggtggggggatcatgaggtcaggagttcgagaccagcctgggcaacatagtgaaaccctatttctactaaaaatacaaaatttagctgggcatggtggcgtgtgcatgtagtcctagctactcaggaagttgaggcaggagaattgcttgaaactgggaggcagaggttgaagtgagccaagatcgtgccactgcactctggcttgggcatcagagcgagagtccatctcaaaaaaaaaaaaaaattttttttttcattaaatgagagacctctaattttctcctagttctttcaattttttctttatatgctttgaagctatgttattaggtactgtgataggcagaataatgccccctcacctgtccacgcccaaagtaaagatgtctacatcccaatcgtcagaacctgtgaatatgtccctttacatggcaaaggggaattaagatagcagaaggaattaagcttgctgatcatttcgttttcaaatacagagctaatcttggattatccaggtgggtccagtataatcacaagtccttaatgtgaaagaagtaggcagaagaagagtggtgtgacatgagaaggattcagcaggtcattgctggctgtgaagatggaagggggcgtgaaagctagcggtatcaacacagagtggctcatgtgaaaacctaaggaaatggagccgcgaggccatgaagaaggcgccctcgtgcacatatgctcatgtaggaactactggaagaacttccgtgttccggataagctgcctgcctcctgcacatacgctcatgtaggaactactggaagaacttccgtgttccagataagctgcctgcctcgtgcacatacgctcatgtaggaactaccggaagaacttcggtgttcccgataagctgcctgcccatggacacttgcctccttccagctcctgcaaccagagagctttgtctcaagacagctcatgtggacttctcattttttccttttaaaagcttctcttgtctcagcctgtttggatatacctatgggtctgccatagcgtgcatatggattgtagtcccctgctattcctgaataaactgttttggaaagccagtctctcgtttattttacgttgacaggggctatgagtcaaaggatgcagggagcctctagaagcttgaacaggtgaggaaatggattcatctctagagcttctggaaagaaaggcagctttgttggttgtagccagtgacgctggcatcggacttccagttagtgtttctctggtacatctttcttccttcttttaaccttctttctgttggtatccttgtgttttaagtgtgtctctggtaagcattatgtatgtgcattatgtatatagattttgaattttttacctattctgacaatacttgttttaaatcagagaatttcaaagagttatacttactatgattactaatacatttggaattatttgaattatttttaccattttattttgtcctttcactttttaaaactattttacttaaaaaattttaagaggcaatttaaaaagttgttttttgggcaataatcctttacagtaggtatttttattccactttgcagctgagaaaactaagacacagagggttaagtaacttgttcaagatcacacaattagtgtgtggcagaagctggacttgaactctgttcatctgactgtagtgactgcatatcatcctggtacagtttcgtttattgagtgtgatagatttaaaaaaggcagaattgtcagtcaaggatgtgccgatgtcttcgatgtactcctctagatatgccctctacacgctgttctgtgctcccagagtctgacctctttggactgttagtgagcctcctgcctggtggctaccaactgggtccagccagtgagaaacgagggcaaagaattaggtccaggtatttattctgacccttgaaccacccttccttcccacatacaagcccttcctgtgtacagggttacctcagggctcactgtgtcccttgggaaaggtcacggctcgtgtcagggaccctgtccactctgtcctctcagcatctagtttctgcttccctgctcttatgccttaaggcctaggggtgcaaacagcagttgtcatttgctccagggcatggcattatttggttttactaaactgtcctaccttttgtgaaattccctttattaaatgctttccaaattatccctgttgattgcacagtctgttttctgccaggactctgactgatacagtgagaaaggaatgcttaatcaaatcagccgtcctttatggaaataaattattaaagccctgcctcacatcaaaaagcaaagcttgaaaaaaatataataagggattaataatcaaaacatataaaaatgtcaaacatctattaaagaaaaaaggcaagccatgcaaaagtaaagttcagggacatatcctaccagacattgtaaagctataggaataaaatagggtaatactggtgtgtaaaaaacacatagttttacagtctattcatcgatcagataccttaaactacctacctactaacaacaattaaaaatattagaggagagatgtaaaaaactattgaaaatgtatttctgaccaggcaagagaagacggaattggcagggtgaaaaagggcaagccagactctagggagggcagcgagctcttagactgccttcaccgtctttctgaactcaagggccgggagtgtctgctttgatggctgcatgggactccggagataggcaataaagcccatggtttctacaaagtgggaagctccaagatttattgctgaataaatctggaaccctaaagtccgtaatgtaaaaggtgaatgagaaagaaatctctgcgcagaagagagaaggaaacaagccttaactcactggagtagcaaggaaagcgcttctctgagaattgatgaccaccagagggcctcccacaggtcttccctgcacattcctgctatcctactggggaggtccaaaacaacctccagcaaacaattcaacgtggtcttcaagtagttgtgtacccaggcaactggcaaaaacaaatacaactcctctctggaggaaagcagcttccacccaatattcaaggcattactgaaggcaacaaaacaggaaaacaggtaaaggattctcaggcaactcacaggacataaaatgtacatcttgattacgaaataatctgtgtaataagcttagaaaattgcctgacacgtaataagtgctaagtaaacgttagctatgatgatgctggtgacaacaatgatgatttcaagtctttttaattctctcctattaattgatttctcttgctttgttaaaatcacaccagtttaattaacacttgtcatattgtaaactttttaaaatgttcaaattttttcattgttctttttagaagttttcttacatattttatgtgagttttaggattggcttgtcaagttcctgaaaaatcatgtttgaattttgatgaggataggggttacctttatagattactttgttaaaaactgacatctttacagtattgagtcctagcatttctgaatagagtatatcttttagtttattcaggcttcttttatgtcctttagtcaagttttatagttgtcttcataaagatcttgccacctttttttagttttatacccacttttccatttatgttgctctttcctattaaatgcttaaattggctatattgaagatgtaagaaggctgttgagttttgtgttcaccttgtatgttttgcgcttgccaaaatcccttactttttctgattgcctctgattttctaggtgaataatcatattgtttgtaaattgtgataatcatttccttgtgaatatttctgtctctaaatttttatcttattgcaatccctgcaccactacaatgcgggattttaacaagtggaacagatatccttgttttcttcttcattttaatggatgcttctaatattttaccattaaatgtaatattttctctaaatttttgatatataccttttatcagaatttgctaagcatttttgttaggaatgggtgttcagtactattagatgatatttatttcagtctctgatagttacatgatgtttctcctttaatacatgactatagtaaattcattggaacatttcttttttctcctctttatcattaaaatgtttatatatacgttggataagctctacatggccataatacttgtctaacattttaaaatttatttttagtttttaactaatacataatagttggacatatttatggggtacatgtgatattttgatatacgcatatgatgtgtaataaatcagggtaattgggatatctgtcacctcaaacatttatcatttctgtgtgttggggatactccaaatattctcttgcagctatttaagaaatgccttacttcagtatatgtgaggggttgattccagggtcccctgtataaccaaaatcgaagcatgctccagtccacaggtggccctgccaaacccacggatacaaaatttcaccttctgtatccatgaattcacatccctccaatactgtacagttttgtaggatttgaactgcatgggtccatgtatacacacattttttttcaaccaaacatagatcgaaaatacatattcactggatgcgaaacctacatatatgggggctgacttgttgaatatgaggttccacaaggccgacttcgggacatgagtgtgtgaggatttcggtaaacatgagggtcctggaactagttccccatgtagaccgaggaacggctatattttcagtttggttggaaaaatatccttgtataagtggatcctggcagttcaaaccagagttgttcaaggattaactgtacaatagttaactatggtctcctgccagtgctgttgaacactagaacttattcctttcctctaactgtggttttgtatccataaccaacctcgcctcacactttcctctcccctgcccttcctagcctctgggaaacactgttgcactcactacctccacaagatcggttttttttagctcccacataggagtgagaacatgggatatttgtctttctgggcctgactttcgcttaatgtcctccagttataaacgtgttgctgcaaatgacagcatttcattttttcagtggctgaatagtattcctttgtggaagcataacatattttgtttgttcattcatctgttgatgagcatttagcttgattccatatcttggctattgtgaatggagctgtagtaaacgtgggactgcaggtcatctgtttgatagactaatttcctttcttttgggtatatacccagcagcggaattgctagatcatatggcagttctattttccatttctggaggaccctccatactgttttccataatagttctgccaatttacattctcaccaagaccgtatgaacattctttttctctgcatcctagccagcatttgttattttctgtctttttgataatagctatcatatctggggtgagatgaaatctcactgtggttttgatttgcgtttcttaatgactagtgatattgagcattttttccctagacgtggtggccatttgcaggtcttcttttgagaaatgtctcttcagatactttgcccatttaaaaatcagattatttgcttatttgcgattgagttgtttgagttcagtgctgggttccaccgtggcagggctaacacctagttccaatgccaagtcccacactcactttgctttccctaccccaagcataggtgttttccctccaggctgtgctgcctggggatgaggtaccagggtgtaggtaatgtgagactgtcttccctacccctttaaatgcatcttttcttgttaagctaaaaccaggtcctgtcatctcccatctgatttttagctgttatgaaaatgctttcttgtatggatagttgttcattttgatgtttgtgctgaggggatgatctttggagggttttttttttttttttttttttgagccatcttgctccacctttctctctggtaatttttaaactttatttaaaaatgttccatctatattcataagtgctattcccacgtaagtgtgttttcttattatatttatgaatccaactatggtggctttctaaaacatcttaggtttttaaaaaatcttattctttgtcccgttaggacagtttatataatattggttttatctattttttgaagatttgaaaaactcttcattaaaaccatctatgcctagtgcttttaggacactattaggacagtttatataatattggacagtttatataatattggttttatctattttttgaagatctgaaaaactcttcattaaaatcatctatgcttagtgcttttttcccccctgagttaaattattacctgtaattttgatttcttctatggttatttggtcttttgttttcttttttcttatgaaaattttagaacattcttctagtatctgttttgcttagcttttaatgttaattaaaattatatggagttaaattttaaatctttaatatctgaggttgttttcttttccatttctattgtactttatttggatcttctttcttttttcttagttagacttggcaaaacttagccagttttatgggtcatttcaaagaacctgggtttcaaatgtgctggtatttttgtttggttttctaattcatttctttttttatgtctaataatttattctactttcctgtttggttttgtttttacccccctaattttgtaagttataaactaagtttacttattttcaatctcttgtgttttctggtaaatgcattttatgctatgattttttctgaccctgctgtggctgtttcccagtctttattttgtgcgctttatttgttatgtatgtatgatgaaaatggaaatttttcttcagtttttttttcttcatcccaaagcacaagtaaggcgttaaatttcaataggtagatagatgtagagatagtagatttttagccacgttttaattttatcctattacatttattttaaaagatttggaagacttgtatttttttaatttgtaaatatatccttttgtcctaaaacttagataatttttgtgaacattccacatgtttgataagagggtgcattactctctgcctctcttaactgtcttattctctaccagtttatcttatataaatattaaaactattattacatgtgtaaaggttatatttgctttgctaagattgtattagctatctttttatggtctggaacagaggttggcaattttttcttgtaatgggccggatggcttctgtcaaaaccactcagctcgccattgtgttgtgaaagtcgccttacacaatatgtaaatgcaagtgcagctctgttccaataaaattttatttacaaaaacatgtggcaggctagaattggcccactggtcttagtgtgccagctcctggtcagcataagccttatgacactctgaaatttagatattaagtttatgtaatatcgtatatgtctgttaaccttttgggtagtaatttgttgaaaaacatacaactttacccattattttggtatttctggtattctcccttttgaatcactatggaaaatccttatttttctaaaccatcgtacttaacattaatgcttgtattctcaacaagcacaatattgtgaaaattggtttgggtcaggaggaggaaaaaaaaatcttagaaattgcaatggctgtgcatggtggctcattctggtaatcccagcactttaggaggccaaggtaaacagatcacctgagcccaggagttcgagaccagcttgggcaacgtggtgaagccctgttactacaaaacaaacaaacaaacacccaaaaaattagccaggcatggtagcttgcacctgtagtcccagctattcggaagactgaggtgggaggatcagttgatcccaggaaattgaggctgcagtgagctgtgatcatgcccctgcattgcagcctgggcaacagagcaagaccccatctcaaaaaaaaaaaaaaaaaaaaaagaaaaggaattacagtgtcttgtggctctccaaagctcagcccaacaaaatcataccttagcatttatttacaagcggagggtgttgagcaaggcaggttcctttgggggttgataatgaaaaataggtaaggtattcaagtttattaatgtaatgctcttttaagtgtttgtagcatctgtgtctgtggtattgttgctacacattttgcttactcctacttttgcaatttgtattttctgtaattcttattagactagaggcttgtttcccccacacctttcaaagaagtctcttggtctaatttttcagttcaactcttgtgcagattcatctctttaccttttatctttactttgccattgctgtgtgttttccgatgcctttaattgaatgactaatttgttttctgcctcccgttccctctgccactcctcctccccaattttatgctgtgtcttttcctctaattataaatctgggtttatttgcttttttcttttcttttctgtgctttctctttctttaacttctttttttgatatgcagcgtccttactgtcgttattttctaaagattttgtaattgcttgtttggcttctttgagacacgatttaatattagtggaggatttttaaaacatttcccttctttagctatttttggtttgtatttttgtcctgaatttcagtttttattgcattatcttcagaggctgtgatccttataattaatcttcttttgacttgaggcttagtttgtggcaacatatgtcatcaagttttctaagtcttccatgatcacaaaatgatagttgaagtcccttacaatgctcatcagctaggatgctttcagcttcaggtaatgaaaaaccaactgaaaatggcttgaatagaaagaacatttattatctacataagaagtcctggagtagggtaattttagaggttgttaactgggggcctcagtagcatcatcaaaaacctacattcaattcttccctactcaatctgacagcttggacttgtctcataggctggctgtcctcagggtctcaggatgacactcacatgagaggttgcatgtcccctttctagcacttctctctttcccttcattcctccctccgtgtgtgtgtgtgtgtgtgtgtgtgtgtgtgtcattcacagaagtttctcttagatccacagctctttcaatgagtggaatggtgttacatgtccattcttaaaccagtcgttgggaatgatatcaccaggggtagtagagtgcaatgttgattcatggcttgagggccagtccaggctagcgatacagagtgggtaatattctctccctgcagacatagcccctggacccaagtgaacagaatcagagttctcactgaatttaaggctaggggtgggtgcaggcaggtacagggaaggcagttaggcaggcaccagtagtatcatctgcacagttgaatactttattagccataacaatgtgcaaacaatccacacacttcatttgggatatttattccttcaggtgtaacttaagcatcttttttgactctaaacaattgagcgtattgtggaaattttccggtgatttttgtcttaaataagtaattgctgcagcgctgaaaattattactataaaattctactcctgttagtatatcagatatatatatttttaccattttctttataattcagaattttaggattttgagcagccagacattgtgttgtctttattgttcttccagcactgagtgctgaatttccagaaacgaatggtaataatgaaaggtgcatatctggagatagatggaagtgtaactcaagatgtgattagctacccagtttgtttttattaaaatgttatttttttctgcatatttgtaattcagggaaagtttctaatgtgaaaaataaagtagcttttcttaaggcaacgtataaaaaataattggtttaacagcattgtgtgaatacagatgagatggtcctattaaaatttgatcacaaagtatacatggtaaatgcagcaagattcatgctaactaattactatttcaagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgcttaaacagactaattgaaatggttgaatgggtaagaaaatgctcccttgaatccacatccttaaatgaggccaggcagacttggaggggtctgtgagcccctgagctcctgtcttacagtctcaggctattggagggggctgcacatcccacatttgggtagatgcccaaattctccttttagtatatactctcccttttcttgggtgttcttggaactctggtagaagacagggagaatgatagattttccttgccctccacagacacaggcaaactagtttctgttaggcattcactctgtgtaacattcatcccaattgcaatggtgatacagctaccgtcaacagactgatcaccttgcctgtgccatgtgccctgtgcacatttactctagtcttcacagtaacctccagagaggtgttatcccattttatagattacagccgaaaaaggttaaggaccttgtcactgaactgcccagtagaagttcaagcatatgctcatggaatttgattttacggaagtatgtaccctttagggatctacagttaggtgccctctagggtgtctagaattgctgaggagcccatcgttccttaagcacctgtgctgcgttgtattgtaatcacctgagggtgctttaaagactatgaataatactcagactttcttctccaaccatttacatcagagcatctgggggtggaacccaggcatcagtattttgcaaagttcccaaacgatgtcagtgtttagccaaatatgagacccactggtttagagctgtaaacagtgcagttgctactgttttatggtagatgttacagaaatatgtcgttgaattgcctataaaatgaattaaagattggagcatttctttttcccctattcataaaccattgtgatcgcagtcttctatagaaattacctattttgcctgatgagatttacttagaaagggaaataaacacatagctatatctctcctgaagtcttcttgcagttactaattaaggcagtacacacattctcagttgagctagaactttagctattgtctctttgctctactgaaggtaacccgagtgttacggctttttaaatgagctggaacaataaatacaaatttcgttggcaagacaaatactttttctcatatgccaacgattatgtaatcaaagtataaagtatccatataaagccttgcttttgaaaataatttcaatttaaaaattaaaaatagtaattaacattggtaacagtatattgatgaccactgtttagctgatacagtgaatacaggtgttcatataaaacatcatttaaaatcgtctatccatatggaacacattacgttttcttccaatttacattgacttcctgttggtttctgaatacaactcaaggtgttaatttcgttttcaaagccagatgttatttggcaggataaaacttaaatttcccctaatagatatttttaggcacttaggatgctagggaacttagtaagtgctttttaaaatctagagcattttcaaaatgctcctttctgttcagtctttcttctctgctaaaattgttatgtgctaggggagatttgtgaattttagagtaatatctttaagaagcctgacagagtagatcgagaccatcctggctaacacggtgaaaccccgtctctactaaaaatagaaaaaattagccaggcatggtggcaggcacctgtagtcccagctactcaggaggctgaggcaggagaatggcgtgaaccggcaaggtggagcttgcggtgagccgagatcacgccaccacactccaacctgggcgacagagcgagactccgtctcaaaaaaatacaaaaacaaaaacaacaaaaaaacctgacggatgtcagtgaaattgggggatactaaataaagagtggacagcagtggcggggcaacaagcagttcttcagtgttcctgttcctcagcgtagccaacttggtcctgtatctccacagttcacaggtaacaagtgccctgttgcttcctggttgactgatgctctctctgttacataacatccctgacaacctgttaagtttgtaattattgaacaaagtcccacctcattggcaataatggcaaacagaacgatgcagctgtttagcttgctcttgattgaacagaggacataagttggctgttagttgactaatgactaaaattttgataaagataagaaaacactaggcatttgagattcatgtaataagtagcttatgcatgtactgtattcaaagagaagatttattttatttttttatttttctattttttgagacggagtcttgctctctcgcccaggctggagtgcagtggcgtgatctctgctcactgcaaggtctgcctcccgggttcacaccattctcctgcctcagcctccccagtagctgggactacaggtgcccgccaccaagcctggctaatttttttgtatttttactagagacggagtttcaccgtgttagccaggatggtctcgatctcctgacctcataatcctcacacctcggcctcccaaagtactgagattacaggcgtcaaccaccatgcctggctgaagagaagatttagatatatgtctgtctgtccatccatctccctacccttcatctaactgtccattcaggacatttcttcacagctaaactctacctcagtttttaatctttaagtccagagctcagtccattgatttactgtattcatcagattttaatggatgcttatagttttgttctcaaagaaaattaaaaatattacttctagtgtggtgtgctgttctcactgcagagtactgtttgttttgtttttaatttacatatatttactaggaagtgcccacactgataaaacagtcagtagtaatcaagaaatgtgactttcttgcactattatttaactaaaggaaagcagaattatagaaaagaatgttaggaatgttatcttcatgagtcagggcttttgcaatgctaggccttctcactttcaatttctctcttgcaaggttaaaagaattattcttgtgttaactcacaattactgcatttgatcatcctttctcacttatgacatagcttctatgacttatggaacattggatttgctatagtagaccagtctgaatctgtctctacatggaatgaccagattgaattggcaccaaagttccactacaaatccttcatccagtcttccagtttgaattggaaatatcaattcaagcagctcacaagtcatcaaatgtttcagtggttttgtatagccagaacaggcagaagaatatgttcctgtatagacagttcattgaaacagtttattctgtattatacctaggtgagttttgaaaagtcagattttttttttaaggtaaactctgatctcatttatttagaagtcagacatgttccaagaacctagaggaaagcaaagtgaaacctccctcctccccactgccccaacattcaaaatagctattataaagccattttttatttcattaggaaaacttttaggagcttttattttgagtcagtgtttctattttatatatagttttaataacttttgttattttaatccagattaaagatagcaatttagagatgggtagagcaggtcattagaaatgatacgggtatcctacctggaacagagtgaagaaattttagtcttgggacatttagggtggtggcaaataactctgcagtgtaacagcgcttgaatacaatgatgacttgtaagggtatcaacattatgggaagacagtgttagaaattacagatttgtgaaagaattttttttgttttcattttctgagaaatagatatggggtgcacagtgatgttatgtatgaagtgtgggatgattgaattagctcattaacatattcatcaccttaagtacttagcatttattgttcctgtctaactgcaactaccaacccttcctcatctcccaacaattatgttttatatactctgttaaagaagtcagagaatatattgggaaaacactgaagtggttccaattttaacattgtgtttgagagcaaatgtttgttaagttttggctaattaggtcacctcattggttgattatgctgtgtaactgagggatttctacacacggtttatttgttaaaaacttaatgtgtataagaagtgatgtgaggatttctttacacttctgctcccatggtttcaaatgtgtctccttctctctatctgcaaccatgacctccctcttgagttacaagccattatttcttatgggttaacagttagtgcagctgttatctcctgtcagaaccataaacctggtgttgattccttcatctaatttcttcaatttgtctctctaaagtgctgttactctggggtattccctgtcttggttgatgacagatgccaccatccgtcagtctctgaagcttgaaactgcagtgtaacagcgcttttcttagttgcacatcctcctgatcatgcattgtcatgaatccctcagaactgtcatttcagcgaggcccctttctgttctgagctggaaagcataatggttctttttttttttttttttttttttgaagcggagtctcgctctgccacccaggctggagtgcagtgttgcaatctcggctcattgcagcctctgcctctcaggctcaggtgattctcctgcctcagcctcctgagtagctgggattacagcctgtgtgacgccacactggagtaatttttgtatttttagtagagatgaagttttgccatgttgcccaggcaagtcttgaacacccagcctcaagagatcctcccgcctcagcctcccaaagtgctgggattacaggcgtgagccactgctctgggctggaaaacttggctctgatgctgtccctgtgttcaggctctttgcaacattgatgaaattactcttcttaaaaacaaaagtaatgatgtcatgcttcccataaagactgtcaccaactactccgtgtggttcctgcgtcagtcttcagtgttagctccctccctgccctctccacatgccacgaggcgagacagcaagtgctcctttgtcctcgtggacccagttctaccacagctctctgcctttgcacgagctggtcccgtggcctgggtgctcctacaaaacgctagagccaggaagagagatgccagcggtctcctgagttaataccgtattctaacgaagatctgtttcacacttttcaaagcttcagttcacagattccagaagaattttgcatacaactagaacatacttatcttttctcagtggcccgtcactataacattaaataagatcttaattgtaaaacacacttaagtgatacactttttcccaggagagagctgataacggtctttaagagcttggaccctggagatgcgtagtgtggtcttgaattcctgctctggtgctgagcagctgtatgcctttaacttctctgtcactgctgcctcctcattgaaatgaggctagcagtgggacctgtctcgtgggatcgctggagggtcagataagttagcatatctgaggctcccaggatagtgtctggtgtggaagcatgtgtatgttttagctgctgttattatcattagtttcaattccctggcaatagcactgtttggagtctcactgtgtattatttaacagattctgaataaagccattttatcttctttttattctttatagatgataaataatgttcctacaactcgaggtatcacgctgtgtttttaactttttttttttttagcattactgaaagaagttgtatgtactttatcttattttgctccctaattataaaatacagggaaaatcatattcttttgcatgaacaaatgagctatttgaaacaggttgcttggtgaaagtgaaaatttaaaacaggattcaggtcaagtataatatattggtttacacttaacagagttcatagtgatttttatatgtctcctttctttttgatgaagaatgtctgtgttccgactactttacttctccgttcattttcatttgttacattctgaaagcataaaacgtgccattggttaatcaatttagtctagtggaggtacacaaattcaaggtaaatttggctaatttctcctgcaggctagaagataaaatcctttccccccaccacagttaggttagtagtgcttgacgtgatcagatgcctcttcagaggtcacctgatttaattgtggttgtgaagcagccaatccaaatccccatattttaatttctatccctccacattctcggcacagaataattaagagtatagtttttgcttatgtcatttatccagtgaaaaatgttcctaataaatacgtgacagttaaaattgttctagagaagaatgtttattaacagacaagacagtgcttattgccacagcatcattttaatctaagacttaactaaaaagagaaactctttttagttagaagaatgctccaacaaggctgttaccactcagcgaaggcaatggttactcttttattttttaaattggtttgcccctaaggtaggcattcccagggctaaaactgtgaaataaaatgtacgcaaggggactggtgcttatagatttgtgtgtataaatgtagtatttgtgggaaatgtcaagctatgtactcttctttaccttttattttctcctagatgatgtttatcagtctttttgtagctgtctgctgcagacatcattgcgtctttattatgaaagtgctatgtgtagctttccagtcattgctattcgagagtgagtttgtgaagcagcaggagagagatgattttgcaaattgcaatataataccatatatgatcttgtctcaacctgtaacacacacatcttcacagaaataacatttaattatggtaatatcctccctgatatcagacacagtatggcgcctgttaagattatattgtttgtagtaagatggagtaaaagaggtttaaaaatgaaagaataaaatcacataccttgataaaccccttagatgctatttaggccatggagagcttttgattttgtttcctttctttcttcccaaaataaaaacgcacacaataatttgacagacaaacactgtcacacactgtaaccccatctaatcccctcactgcacatcttaatccctgatggacttttctcagctatgtgggctatgaggttagggagtttctggatgtgatactttttccaaagtttcccagtgacagatgcagtgaccttatcacggagacagctttatgcagtttgacagttcagccatctggcttgtatcgattataattgatttaaagaaactaacactccaaaagttggccacttaaaaccctaaggctaaattggtctacatttaatttgaagtttcaaaactttattcttaaaactaatttgggcctctttgtaaaattcagccaacttcttttctgtgtggggttttggggtgaaaacactcaaagcctgccttgaaaaaagtcaacttttatgagaactaaagacgacatgtgtactcatagacatagattttatctcttcttagattttgctagagtttaaaacttaggtagacttcggttctaggacttcaaaaagtttagaaacttttaggctagtttctttatttaccagccttctagacgtgagctcattacctgaccttttagagtcttggttttctcatctataaaatgaatgatgatagtagctttctcattgcatttttgggagtattaaatgatacatgttaagtgcttaacacattgcctagtatattgtgggtaataaagatttattttactaatgattactgctacaaattagtagctaccattgatagctattacttcttcctttcttggttttccatctgtcggcttcctcttgttttcctccaatatcacagacacagttgcttagtcttgtatgtgtttcttcagctctctgcatatttgttaccggaatgtctcagaatgttgcctgtaggcctcatcttttttttttttttcccctttactccctccatatacattctcatccacaatcaagacttcagcatgttcttgtatgctgatgagttccacatggtcatttccaactgaagtctcttttttgggctcatctgaaaggcatttcttatcctgctacatgacactttaggggacccagtgggcataagggcaagtaagcatcaatttgggaatgaatactattgatctggcactaacttttattggttgattggtaagaatttgcagaaatctaaagtttaattaaaattttgttttatactttgtgttttaaaatctgatgttgcatatcacactgtaatacaaatgcattcagtaaagtgtgccctttctacaactcttgattttaatgtagttactggaattatttgtttggaaaaacctggctttctgaatagctgaaattttacgcatttcagcaataatggtgtccttaagatcgacatctttccggattcattttttgtattgatttaattcaacaatcatttgtgcaacagtaacttgcttacaatgccttctcaggcactaacttgctatattaaaatagaatttattaactgaccattccttaatgacttagccattttttgtgtgttttttttaattgtcagatgtatgccacataaagaaaagtattaaaaatgtgtagtatggtgtaaagaatagcaaagttgagctccaaactacccaacttcaggttaacaacattgccagtgtcttagaagccccatgtgttcctctctcattgtttccgtctctctcagcctcagaggtaaacacgtcaggtttgctagctcttctttatggactaaccaccccattgttgttttgcataaagcagtgtattgttgttttaaaaatggagtaacttgtatacccatcgctgtgtaagggcacggcagtgttgccactgcaggctactataagaagagaaacggagctgagtctgggtcatagccgggcctgtttttccctggagtttaccaaagccccttctgtggaagttagtggccaagggcaagaatgggtcctgggaaacacagggcttagcatagtccgaacaactaacagggctgttttgagggtcatgtgtcacatgtctgacagaagtatgtttgtaagttcactatgagtagatcaaagtgggccattatagggtgaaaggaatgtcctcagctgatagtgacatcaaggcagggctgggaattgacggagatagagtgggaactccattaacaggtgattaggacaagtagccataggagtcctggtcaggctcactggggtgtcttgtcttcaggttaaaaaggtggttgggtgggtgagtggggtttagggggggtctggtgacagccctcaacttgtctatcgagtcacattgccgaaatgtgggcctattctctctatatctgttgtttagctctgatcctgtgatcacatttctctgtgttttgaggattccatttgcttcttatttgtactgagtctcctttcttatatcccctattttctccttcttggactactcttgtgttagtggaacatgtcatctggtatcttaaaacgtcatgagaaatgcattctttgagatcttgtaaattcaaaaatgtagacattttttctaccctctttcttagatttactgggtagagaattcttggtgggaaataattttcctcacttatttgaaagtattgctccattgacttcttgcttccagtgttgctgttgagaagttaagagtcattctgctttctcattattcttatgtgatcttgctgtttttctctgattatttgtaagaatttctgttttctccagtgttttgaaatttcacaatgatacagctaattgtagatctcattttcctttgtgctcggtactcagtggattctttaaacttggaaacaaatttcttttatttctaagaaggcttctagagtcatttcattaatgacttcatcctttaattttttcctctcctttctttctaagactcctgtttggaagttttgcctcctatactagtcctctgtttttcatgttttttttcattttttattttttgacattttactttctgggagatttcattttccaactgatattattttcttctatcatgttaattattaagaattctttttcttcttgcagcatcctattcttatttaatagatgaagcattttttaatatctgataattttaatgatagattttttgaagttttctctgcatactttcttctttattactgttttgatttctaacttctctgttaaaggcttttcttagatgactgttcattgtatatgtgcttataatgcaaagtggcagactaaaacattgaaagtcttgagcatgcagattaaagatctgggcatattatttcattgcagggtgatctgcttgagctcttttcttggggtaacttttgtcagtatcttttcttagtatctttagagaattcctcttggactgattagattccttagggaagactccttcagttttctgcttggctattaactgtttttactattcttccctctgttttctccaacttgctctttccaacttgctatgggctagggaatcaggaaaaagaaaaaaaaaaactgatcaggacagtttcaaagtagaacagttaggttccgagtgacagcctaagggattggcctgtgcgtaaaatgctttaatgtgtggaatttatgacattgattttgatgacccaggagcatgtttttatttcgtgctcctgattatattgtggaaaggtgatttagtcatacaacagaattctaagtagatgaagtattaatgcaaactgttatagagtatttgtttttcttaatccatttcatttgatccactgtgtgtacttttccagttgattataaattgatttgttcattaatttgttctagttactggtccataattatcataatgtttttattttttgttgaagtatgtgcagtattttggactttttccagttatgatggactatcagtatgttctcacaagtaatgggacactgtattttacaaatatttattactcttgatgttctctaagattctgtattatgagctcttgttgatttacagacatttggaaatgtaactatttgattcttattcttggttaatgttttatcctcctagaccaaaggtgtttattctttagaactttatatgtttgttttaacagctggatttctagtgataggcaaacttttaacaaaaattccaattacatataagcttactgccatttgatttctataattaaaaatattaatattattagtggggtttagtcagtcactatattagacaaacgtgtgagttagaaattcaggtgtacacaaggattattaattggggcttcttcaaagaattttgacattagtaaaatttttcttttttttcaaaatgtttcaaagatttttttttaattaattaattaatttatttttagacaaagtcttgcttaaagtcttgctcttggccaccaggctggagtgcagtggcagaatctcggctcactgcaacctctgcctcctgggttcaagctattctcttgcctcagcctcccgagtaggtgggattacaggtgcctaccaccatgcctggctaatttttgtattttttgtagagatggggtttccctatgttggccaggctgatcttgaactcctgacctcaggtgatccaccgccttggcctcccaaagtgctgggattacaggcgtgaaccgccattcccagccaggatgatttatttttaatagcacccctaatgtatttaaagcatgattgcacatacaaaatttggatttacatacattttcagaactacccgttttgtgtaagtatacacttatattttttaattttaaaaatattaaaattttgacaattttatgtgttattggggtaccgtttggtattttgctatgtgtttacaatgtggaatgagtatatcaggctaattaacaacacatttcttacacgtgagagggctgttttttagaaatcagcttcagcttttgattttctgaatgaccttgagcaaattgttttcttgttctgtaacatacttttcttggccataaaattgagatgaagatgttaatgctgatctaaccaaatgattttgatattatagggattaatgaactgtttgtaaaatattttgttgttcttggaattacttacactggtgatgttattaatattatgtactatgttcacagtggactaatgatgccattgtattagctaatgttttagattacttttaattaaaattgtatggagacattggtgtgcttgctgcaatcttgtcctcctctgcaaatggcaagggagtattatcacaaaatatttaaattatacataaattcaaggtttttaagaatttgtcaactccctggaagaagaagaagtaagaaattactcattaagactcaggaatctcagcatccctatttggaagaattggattatttggcttatttataaatttcaaaatgatacattttcagctaatgatgattgaatcttgtcagacaccttacacaactgtgaacattccacaagttaagaaaacaacttcaggtggggtgtggtggctcatgcccataatctcaacaagttttgaggccaagcaggaggattgcttgagcccaggagtttgagaccagccgggcaatatagtgagaaccttcctctataaaaagttaaaaaattagccagttgtgatggtgttacttatagtcctagctactcagtaggctgaggtgggaggaacactagagaccaggggtttgaggctgcagtacgctatgaccatgccactgcactccagcctgggtgatagagccagaccttcatatcttaaaaaaacaaaacaaaatgcatttatagtaccattaataagaatgatatacttaagagtaaactttaaaaagttcaagactagtacactgaaaattttaaaatattgttaaatcgaagatgtaagtaaatggaaaggcgtgatgtgtttatggattggaagacttaataatgttaaaatatgtagataaaggcaaggcatggtggctcatgcccgtaatcctagcactttgggaggccgaggtgggcggatcacgaggtcaggagtttgagaccaacttgaccaacatggtgaaaccctgtctctactaaaaatacaaaaattagccgggcatggtggcacgtgcctgtagtctcagctactcgggaggctgaggcaggagaattgcttgaacccgggaggcagaggttgtagtgagccaagatcgcgccattgcactccagcctgggcaacagagcgagactccttctcaaaaaaaaaccaaaaaaattatatatatatatatgtgtgtgtgtgtgtgtgtgtgtgtgtgtgtagataaaacacaattcatatcaaaatcccagctggatgctgctgttgttgtcgttgttgttgttgttgttgttgttgttgcagaatttgaccagctgatcttaaaaccacacagtgataatacaagggacccagaatggccaaacagtattgaaaaagaagatcaaagttggaggactcatattttccaatttcaaacttactttaaagctactataatcaagatgctgtggtactggcataaagaaagacatatatgttggtggaatagaattgagaatctagaaatctttacatttaatagtcaattgattttccagaagaatgctattaagacggttaaactgggtaagaatagtcttgtcagcaaattgtgctgggacaactggatatctacaagaaaagaatgtttagatccctacctcacagcatatgcagaaattaactcaaagtgcattatagctaaaactatgaaactctcagaggaaaacattggagtaaatcttcattaccttgggttaggcagttgtttcttagacattacactaaaagcacaaacaacagaaggaaaaaaaaaaaaccatacttggctggtgggggatgtaaaatggtgcaaccactttggaaaacagcctggcagttcctgaaaatgttaaaatacaattaatatatgacctagcaattctactcctagttatgtacccaagaaaaatgaaaacataaatccctgcaaaaactagtttccaaatgtaatggagataggcagtcagtaaacaaaatatataaaatgcccagtggtgatacaactcctgatgtttcatttcattctttttctatatggtaagcccccttgactattagaaaaattgtacttaaaaaatatagcttgtacatacttcgtcagaataaagtaggaatgttacttttttcataatctcttttaggtcaattgaatattttaaaatatatctgtttttgttttgctaattaaacctatttttttttgatctagggtttacaatacacatctgtaatttattgttcaactgactgagactgggtttcactctgtcacccagtttagagtgcagttgcatgatgagaggtaactgcagcctcaaaccccttggctcaaggaatccaatcctcctgcctctgcctcccaagtagctaggactacaggtgcatgccacatctggccagtttttgaaatctttttgcagggatggggtctcactctgttgcttcagctggtctcaaactcctaggctcaagcaaacctcccacctaggcctcccatagtgctatggtgataggcatgagccactgcacttggcttattgtttatcttaatatatctcttcacataaaatatagtatgcttaaaatagtatatagttggcccttgaaaacatgggtttgaattgcatgggtccacttgtatgctgatttttttcaataaataaactcggccctctatgtctgtgaattctgcatccacaaccaaaagtggctcaaaaatacagtattcctgggatgcaaaacctgtagatgtggagaactgaccttttgagtatgcacattctgcagggacaactgcaggacttgagtatgcttggatttagtagccatgggaggtcctggaaccaatcccctttgaataccaagggaagactgttgcttttatttcttccttcctgccccttgtgcaattactgttatgcattttatatttatttttatgtttgttataagctctacaatacatttttatttttgctttttactgtcagttttctcttaaatttaaaaataagaaaaaaattcatttgtagacacccacatttaccattcatcatattctttatttctttttgtagatgcaagttttcatctgacaacactttctctttgccaaaagaacttcttgtagcttttcttgcagttcacatcttctgacaactagttctctcagattttgtttgcttgaaaaaaattttggtactatttttgaatgacattttcattgtatgtaggattccagggtgatagttttatttattttttcctgaactttgaagatgttcttctattgtcttctggcttatattgtgtctgatgaaaagtcagtaatcactcttacctattccctgtgtaagttgtattttttccctttgtttgcttctatttatcactagttatcaggaattttctttgttattattctcttttgggtttcgtcttttaaatatatggtttcatgctttcataaaatataatttgccaaatttttaacattgtattttcaaatgctttactctcttgactctgatgactctgatgtactttgatgacatgcatattatattatcatattatattgtttgctgttttccctttttactgagagtgtttatttcttacagtcttcctccccctgctccccaaccttcagtttatgtagctgctcttgtgttgtattcagattcactgatcttttcttctcctatatttatatgcatttaactatatccagggagtattccagttcaggtgttgtatttttcaactccagatgtttgattttttcctatactttatttaaatacattacatgtcttgtttttttttttaaataaacacacacatttattcatttgaattccttccttattaattccatcatctctatcattgctatatctgtttatatagtctaatttttctcttggttaagggctgcattttcctttagagggtatttgtttttatttttgtgggaagctaccttacaagtatgtcaacttagtctcttcaagccggggttttgagttttgtttggtgggtgaactgtgtattatcatatggtttgtttagccctaatcccggtacctggtcttctagggtgtctgctgaatgccctaggtgtttactgaagttccagtgggactctaatgtcttcaacactgtgtgtacttcagcatttacccagcttagttctctctagtagttgtcgttttttgtgttgtctcttgaaatctcaccctacacatgtgcagcgtagtattcagacaaaaaccaaggggacctgtatgcggatttctggacctctttctttgtagaactccttctgtttttgtattctcccttcaaattgctctgatctctgtgttgtcatgtaacaagaccattgtgcttttttggggtagccagtacctacagcatggtgcagtaaatgctcggaataatagtctagtgtcaggaaaccattgtttcccatattctgctttctggttgttgactgcaggaaggactgatctagtgctagttactccacagtggctgacagtcccctctgtattattatttaacctgttattttatagtccattaatgcagaaatgtttccatccttgctgtactctcatgtccacaacaaagcctgacacattctaagtggttagtagccatttactgagtgctgtatgcagtagattatctctccctttctcctgcatggtcaaatttttccttcagtgcgggactccctccaattagcattggaatatgtgttagtctccctttgtcttaaaccgccatatctggacctgcccttatctaattcccaacctgcttcagtgttgctttcatccagcagttccattgcaataatattcacaagtgttattgatgactcccctatggtttaaacctatctcggtcttaatctcacttgattcctggtggcatttgacactgctgactgtcctggaatcctcttttcccttactttcctgaccccatattttctacttattttccttctggctgtccctttgtctgtctggcttctgtttctctgaccaggcataaactgctactgatagtcagggtgttgtccattgtccttgttgttctacaaactgttgccttgtaatctcgtaattaccatccagaagctggtgttttctgaatatttttttttctggtttcagattcatgtggacagttggctgttgacttctctgtccctgaagctctcaaaagtatgccccaaattaagctaatcattactctttcctctctgacatcatcattcttcttcttcttcttctttttttttttttttttgagacagaatcttgccctgttgccctggctggagtgcagtggtgtgtgatcttggctcactgtaacctctacctcctcggttcaaacaattctcctgcctcagcctcctgagtagctgggattacagctgcccgccaccatgcctgactaattgttgtatttttagtagagatggggttttaccatgttggccaggctggtctcgaactcctgacctcaaatgatatacccgcctgggcctcccaaagtgttgggattacaggtgtgagccaccccgcccagccttacatcatcattcttgagattgcaatttagatagctctaatttcaagagacctttcctgattcttcaaagtgttctgtaccttttccatcttgacacttcgaaccctagtattgaaattgccttgtagtgcattggcattgccccaaacctgtttatttccctcactaggcgtgaaattctttgaaggcaggaatggctgctatcagtaggtgctcaataagtatttggggatggataaatgaaggaatgaatgatattataggaagtgagtattttattcagtgcaggatttagtttgtttttctgctcttaaaggataaacatatctgcactgttttaatagaatgttctagtaatatctgtggcagtgatggtgggtcatagcaggcaggcagcagttgtgaactcagcatatcagggcagcctaaggaaggtggggtgtgtgtgtgtgtgtgcgtgtgtgtgtgtgtatgtatgtacatgcgtgtgatactcagacacacagacatccatccatcttaaggtgtcagaatattaagtaagattaagttgtgttagacaatggagtcttacacagtgacttgacccccaggataccacttctgttacagatgcttggggaggggtcctctggtttttctgtttgtgctggatttctaatattcatgataggagcttctcaacctaatcctggagccggagctgcttgggtttgaatcccagctctgccaacatgtgacctcaggcaaataccgttacttttctgtgtgtgtttcctcagttgtaagacagggtaatgataatacacaccttcttagaggtaatgtctgtaaagcaattaaagggtgcctggcacgtgataattgctatgtaggggcttattaaatacaaccacaatgtttggggccgttgtgttacctccattttacagttcccaaagtgagacccaaatagctgagtgttacgaagtgtccctccagtagcagagctggtctgtctgtctctgggcccctcttcctcaactgtgcttacctgcatcttcactcaacacttaacctctgtttaatgtcacagggcaggctcagagagcagcagccagacatgggtgttttctaccttcggccctgcagaggatttctgtaagaaaagcagcatgacagagagagccccccaggacatacagaaaatgagtacttagagtctaaattatagagaatggaatgttaagtcagtggttctcagttcagactgcacgttagaatcacctagtgggcttttaaaatatacagatgccagggcttcaccccagactcattaaatgaaggtctccgagtcatgaataacatcggtgggtgggggccaaggactttccagagctccccaggtagttcagatatgcagccatggttgacaaccattgacttagaactgggagggggctcccttattctcttgttcctccagtgtttcctaagcgtcgaccttatcaaaagtaggtctgacagtgtgttcccagtgcctggacctggatattttttacttcagctttaattcaaaccattatgtgctgctagtcactgtggtgtgggagcagcagtgcacaaggtggtgaggaagccagcctgcctcaaggagtttaacatttcctaggaaagcagtgtctgaatacttagatgattctataactgacttgcacagacgttctgctgtcacagtaggtattactgaataatgtggctgctccaagttttttagttatgttccatgtagttgtgagtcactgccaaggcactcggtcttctaaagggtctctgaaaaatcactgacgtgaggcggattaataggcaaaaaggcatgggatttatttaatgtttgtacatgggagccctcagaatgaagacccaaaccccaaatgaggaacagaaacttctgtgcacttttgaggttacagaaagaatacaggctcagagaatggcccaagacaggttttagtggcaagacaagtaatgggagggaagaaggggggaggcttggctagcaaaggtggtcttattatacagatgaaacctcagagatagcagttctcagagagaacagatgatagatgtttcttttcagacgtttaaaggctgcagactctcagtctctcctacatccaagacaggcctggatacgttcatggagattctctgtagatgtaaattaccccaacaaaagatggcattccagaggtgtttctgtctgctggccctgcagccgccatttcaaaatatgtcaaattaaaatattttgatttccttccgtgggaagccatcagaacaagaagagatgagatcaaacagcaaagaattgccctggctgctgtcttgaagagtgtagggggacgagggtgaaaatggaggctgtcacagcagactagacaaatggtgacagtggcttgggccagggtggcaggggcatctttgagagtagagccagcaggattaggattccacggtctgagaaaggaaccaaggacgactccatgttacacttgtttctgctcaccatagtctgtgttaataggtgatttagaatttcatattttccttcttgggtacttacaagataatttagtacttctgaaaacttttctatagttagattatttttgctttctttttagatgcagaataatatctacctatttacgtgtgttgagattttgcatttgatttcagtgctaaagattttagataaagctccaattcaaaaataacctgaattcttggaagtttaaattacttaaagttcaataagttgattatttaggtcattttacttactttagtgctttacattaaaattttcctgtttaatgaacatttaactaattaggaaaatttattagtcaaattgtcagactctgttaaatggcttgtcaaaatgtttgtttagcagttattcctgtcttcttaacattgttgatctttctaaccctctagttcagttttttctgggtgattgtgttaagtggtagtatttaccaattattttaaaaatcctttattatgaaaataagtcactgtggacagttaaagcataaaaagtttaaagaagcaaaaaataagcatacaaaatcaaccattattttaccattcttaggcagccactgttttttttgttttttgtttttttttaactttttagagcaattttaggttcacagcaaaattgagtagctggtacactgatatctcgtatgtctcctgcccctgcacgtgcacagcctcctccatgatcaccatcccccaccggagtggtatgttgcaaccattgatgagcctgtattgacaccaggatcacctgaagtccatactttacattagaattcactcttgatattgtacattctctgggtgtgggtgaatttatgaggtgtgtattcatcatcacagtttcctacagagtcctttcactgcccttaaaatcctctgacctctgcatagttatctcttccctctaacccctggcaaccacacgtcttttaactgtctctgtagttttgccttttgcagaatgtcgtatcattgggatcatacagaatatagacttttcagactgataactttcacatagtaatatttattgtttcctccctgtgttttcatagctcatttgtttgataactcacttgttttcagtgctgagtaatattccattgtgtggctatatcaaagtttatgtattcacctaatgaagaatatcttggttgcttccaagttttcgcaattatgaataaaactggcataaacatctgtgtgcaggtttttgtatgtggaaataagttttccatttctttgggtgaataccaaggagtgtggatcatatggtacgggtatgtttcgttttgtaagaagccaccaggctgtcctcagaagtgactgtaacattttacatccccagcagcaatgactgagaattcccattgctccgcatcctctttaccatttggtgttgtctggattttggccattctagtgatatgttgttgttgatgaagtatctattaaggtctttggctcattttttaattggttgtttgaagcaactacttttaaaggtattatttccttcctgtctttttatttttatgcttttttatgtgagtggttgagatttggggtaaatattccatctgttttttttccatttaacgtcacgatgaaatctttttctgttttgttaaagtgcattatgtcattgtaacaggtatgtaattataatgagatttgacattcacctattcttagaaattttggttctttctacctttgcaaaattataaacaatattgccattgagatgattgtgcctgaaaacctcccctgtgttttgtgttgttttcttagagcatatcctagaagctaagtgactggtttggagaacagagacatttttgagggtctttaaacatattatgagattactttccaatgtttatattaataaaaatactagcagctaacagttactgagctctatgtctgtgacagacactagatttagtctttcagatgtttttcagttctcccagcaccactgtgggtggacttaggacagttcttgttttatgggtggagaaactgaagcctagaaagatggtaaaagtggccaataagagacagtaataatgacagagtcgaataaagagatatgctatatagaggaagactattttttaaatttcggttattctcaagttgatttacagtgttaacagagttccaaacaaaatcccttaattaaggtaaaatatagacgttaatatttatcaactttttggatgatgtttttaaatttcagtgcaatagaagaaatcatataagacacaaagaagaattaagactgatgtggccaacagatgaaggaatggcaaacaatataaagaaaatatccatatttaaattgttttaaattattagtgggcatttttattctatacagttcgtaatagttttaaaataatttcaacttttattttagattaaaggtatacatgtgcaaatttgttatgtgggtctgttgcgtgatcctgaggtttagggtacagatgagcccatcacccaggtagtgagtgtggtgcccagcaggttttataacttttcagtctagtcccacccacccttagtagtccccagtgtctgttgttcacatctttatatccatgtgtactcagtatctagctctcatttatacgtaaggatatgtggtatttgtttttctgttcttgcattaatttgcctaggatagtggcctctagctgcagccatcttgctgcaaaagacaagattttattctcttttatggctgtgtaatattccatggtgtgttcctaccatgttctctttattcagtccaccattgataggcacctaggttgattccatgtctgtactgttgtgatggaaaatattcatatttcagaagtaaggaaagaagagagggacgacaagacaggttatcagtgtttcagagcaaatgtctttagactgcctgtctcatggagtttgtatgtttttactctaaatctccagtctgatttttgtgtataggagatttacaatggacatttctgcattttagaagtagactatgttgtacagtctcctgttatttcttgggtgtgtctttatgtgtgaatttgtgttttctgttgatgaaacaagaaaaaatatatacttaaaacacccaaatatatctgtagataatttacatatcagttgatgaactattactgtttttgatagaaaatccatgtggcttaagcaagggaaaggtttgtttctctcttaaatgtagagaggtagatagtccagggttggtttggcggtcccacagccattaggacttgggcgtctttgtcagtcactgctcgccattcacctcgtgtgtctcgtcactgtcctaggtcagtgctctagtctgactatgatgcatttcagcatgcacgaaggaggagagtagtagatgaaaatgggcaggagtggaagggagcatatgcttagctgtcatttaaggaggtttctgaatattgccaagtagtacttagaccccgtctccttgaccagaactgtaggtacgtggaacaaggtacattgttttatgcccagctgaaaatcaggatttgtattactaaagagaaatgagagaatggatattgggcagtgtaacaatctttgccccatcacgcgtgcatgcgtgcatgcgtgcgctctctctctctttctctctttcactcatttaagtgtgacaagagcaaaagaaacatttctaatacaaatcagaacaataatcacttgggcccttttctctgctgaatgtaaagttttcataatgaggcattattaggcttggagggtgcctttggcactagagttcccttgacatcatccaagatattctgcgggtagaaggagcaggtgagagaagcggggaggctggtcttggtggggaggagacaagacctggaggtgcagtcaattctcattctgctgttttgagcaaccttctgaagaagagcagggctgtgcaactgaatactgactctgagcccattgtgaccctgctgagagaacacctctaggaggaaagagttctgtattttagaaaaagaagaaaattcgttcttcttttgttgtgtctatattaaattcagaaagaagtaaggctgaccagcaagacttgggagggcacaaattacatccttctgaattgctaagcacaggtccatgtgataggcacttagtaattactttaatgacagtgatgagatggtgctaaaactatcataatttctaactctgtaacttcatgaatgattttatttaaaaacacacactgtcctttttaatttatgcttacagttgtatttgtgatcaaatcaagtgttctctataatctagaatgtactcttaaaatagtagacttctcttatgctccaaaatttaaaactgaaggaacaagtaactttcgtgttttagtatttggaagtcatttcagaatcatataaggaggttagccaaagagaaatgttgatgtaaattttgctttgtacattttgtgccatttttcaactcgattttactgctgaaattacacatgcattatttaaaaatcccagtggtacagtctcaaagacataaatcaccttattttgatcagtttttgaagattgaaacaaaactaatgaaaaatattcttcactaatgaaaaatattcttcactatgtggaagagatttagctgaaatttttcgtttttgacctttgaaaatgttcatgtagtataattagggctttctgcacatgtcatttctttgctaattgttttatacttatagttcatcagatgagagctaaagtgttaaatcttcaatgcatgaagttgaaaatgtaagaaaattgtagaactcacctttgttcctgttctttaattcagaagatattttctttttttttttttggtatactcaaaaatatacatttgcatgtatataaacatatatacatgcacatacatttacacacctatataatgtataacatatagaggttatatattatgtgatatatacatagtatgtataccatcaatttataatacacatatatactatgtttacttatacatgcagctgtagatcataggatacacagacaaaccccaggaatggcagctacctatgtcataccatcctgctgggtgatgcttttcatattcttttaaccaacaactaacttttataatttgaattactttgtcacaggctaattattgaaagtataggtaatttttaggtgttctacttaaagagctattttttactgagtgtattttaaaaaattattatgaaatcttttatgaaactattctcctgattactaaatgaaatatttttagagcttccatgacctcttaaggaattcattttctggtgtgctactaacagtattttcacaaaatgctttaagcatacattaattaggttgtaatagtcttttggatgaattatgtgtttgtataaatgataatttggaaaagttcatggaagtctgatgtgaagaactctattgtttgacaacagtttgaaagatactgagtattagacatttttactttaaaagaaatggagacaaaatcattcaaaggaacgcactcacttaagaattcattaactgtaatagactttatcacccattatttggggacatgaaaaagtgctcatttcaagggtattaagtgccatgttgggtcagatctgcctgctgttctcagatgttgataaccagatactttatctttttggtgaggtgatgagtgtgtgtgccttttattgtgttatctcagaagattagggttataagcaaacattcctgatttttctctgtagtctgtattttatacattattcataaatgtatgaaaatcattactgaacctagttacatttttagtctgaaccatttctggaaggaatttcctaagctttctgaaaaaagtagcagcatgtggtgtgataggaagctgtattattaggtttataagagtgcccagtaattcacgcatgttcatcattatgtaaaaatttcagttattccctatttattattcattttgtagagcactaatgtttaatctgttttcatgttgaatgcatatcctcttaattattttagctgatttttgtctagtgtacttcatttcctcttgagctatacctttgtaaattctgtagagtattagagagagagatgcatcatggttctacagaacagaaactcaagtagtgttttgtgtttttactcctcttcctggcaatactcaacacttttgcttgcttcctgcaggaatgtattgacctgttgcattaggaaatagcccacaacgacttagggagccaggcacatatcacttttcatgacttgcagctcagagcctgtcccgcctagagtaaggtggaggtataattttggatgtgttgctgcaggttgtccatgttgatgcccaccattgttctgctaaggctttcagctgttctgtgttgtatcatctgttcgccttgaattgtattgccactagtgcttcctttttccagcacaggtaaagaattgcctgtgcatttcctctcctaggtcatcattacataagaccattttaatacctcacactatagttaaaattgctctttctggaaaacaaattcctttttattatggtatctttagcccattctcagtgactaagtcttttttctcagtttaatggtaattcatttgaagttttttgtgtttgtttttgtgacttctctctctttagtggagaagcttaccagaagtacttaaagagccaattaagttacagttttaggcccttattttgtcaaagcatttatttttcaaagtgttttagtaagatatttatagtttttatgtttgtttcccctagaagataagatgagcttatatagcatacccagtttgagtatgaggcaggaaaatacattgtttagaggtgaataatttattttgtactattctttctgcagataaaattagtaatatgtattaaaaattttaaagcatgagccttttctcttcaggacattgatctgggaaataattttatgaataatatctcaaaaacacaggcaacaaaagtaaaaataaatgggattatttcaaactcaaaagcttctgcacagcaaaggaaacaacagaatgaaaagacaacctacagaatgggagaacatatttgcaaactgttcatctcaaagggaactaatatccagaatgtactaggaacttaaacatctgaacagaaaaaaaaaagaaagattaaaaaatgagcaaatgatctgaacacacatttctcaaaataatacatatacatgagcaacaaatatatgaaaagtatgctcaacatcactaatcagggaaatgcaaataaaaaaccacaataagatatcatctcatcccagataggatggccattattaaaaagacaaaaaaaaacatgctggcaatgatacggagaaaagggaactcttacacactatgcaggaaagtaaactagtatggtcactatggagagcagagtggaagctcctccagcaatcccactactgggcatttatccagaggaaaggaaatcagtttatcaaagagatacctgcacttctgtgtttattgtagcactgttcacaatatacaagatatggaagtaacccatgtccaacaacagatgaatggataaaaaatgtgctatatatatgcaatggaatacgctattcagccataaaaaaaaaaaggaagtcctgtcatttgagacaacagggatggaactggagggcattatgtttcttgaaataagccaggaacagaaagttaaacaccacatatgttctcatatgcagaagctaaaaagaagttgatttcatagaagtcaaaagtagaacagagaataggagggttgaaggaagagtgggggatagggagagagttgttaaaggatatgaaactccagctagataggaagaatcagttcaagtcttccatagcactgtagggtggctatcattaacaatgattatggtttaaatatgtaggagggtattgactgttcccaacacaaagaagtgataaatgtttgagatgatgaattatgctaattacccattactatatattgtaatgtatcaaaacattactgtgtaccccatacatatatatgattattatgtgtcaaataaaaataaaagtgtgagccttgctacccaacaattacacttttggggatttgttgtatgaaataagagtaacaacaataatagtcaacatttctgtattgcttgctatgttttgggcatgatttaaagcatttgacatacatgtacttacctaactcattgaaatcctgtgagtaggtactgttataccagttttataaagaaattgaggcagagaagattaagtgatttgtccagttttagtctgtctctgttacatccagagatacgcataaaaaatatgtagaggattagtaattttaaatccatttatatttccacaatagaggttatcattaaataagaggagactcatataatagaattctatgaggagataaaaacggcaagtctagccttctgtaatgctaaacttataagaagtataattctattttagtaaaaaggatgttagtatacatatattgaatgcaaatattgtgtgtataaactagaaagccatgcaagagaatattaatagtactgatgaactctggatattgggattaggagtgattttatttgtgcatatgtttttctattttacagtgctttttcattgagcacattctgcatttgggaaagaaaggttatttaaagttgttcttattaaagttactgcatttaattctgtttttgccattgtgtcaggcaagtaaaaatgctagatatcaagttaccagaatcttctctggagcccttcctctgggggttacatgtatatgctgcctgtcttttggaatagtgatttgtaagtgacatggtttaagggtttggaccaacaggttcatagtttcaccctgctttcttttagagctgctggataaattctgtccggtttcaatgatttatctatatttaggttgtcaacctaggtaagaacatcctgtgcagctctctgtttgctctattgagtccttgtatggttatcttgttagtatagtgctaatgataacaggctgtgtgtaaaagctctctgtacacagctgtcgaactctgctgtgtttggtggtgcagactacaccctgaatcctgttaaagaaaacctttgagatcataacaggatgtttggaagttttaatataaatctcttacttatatcaaaagcagttgaagcaaatagtcttaaaatatagtagaattctaatgtatctgacctgcttccttaagaattcagtttggctatggtaatctctgcaatcttctccttaaataaaaactgaaacattaagtctgccccttttctttaatccctgttcaagagggtatgtcgatacttgaacccttttaccagcatttaaagaaccagctgctgctggcatagcatgtctgagattgcattttgtcctgcctacctttttattagaccttgcacagccatatttgtgagtggattagtttcctgtttttgccataataaattaccacaaattgaccagtttaaaacaacactcatttatcatttcccagttttgtaggtcataagtctaggtaaggtatggctgcactaagcctctgccctctcacaaggccaaaatcaaggtgctggtagggctgtctatgttcctttctggaatctctgaggatgagtcttcttccaaacttactagaattgcctgagttcagtttctttgattgtcggatggaagcctccatcttctgccagctcttggccaggggctggtctttgcccatgaggctgctcacatcccttcgtgttttccatgtgaccctgtccagcaagagcagcttgagagccattcaagggaatcttttacttcccttctgctacatctttctgctttaagagatcatgtgattagattggggccagccaagtaatccagagtaagctccctactacatttgaaagtaccttttgctttgtaaagtaacagattcatgggttccagggatccggaacatggacatcttttgggggccactctgcctaccacagtgagcctgttctcatgtatacaaacatactctttctatctgtttagcactacagtggatacccagaccataagcgtcatagtcctgacacacgagttggtaaaaaactaactgggaacttgtgataagcacttatgttagtgttttaggagtttaaaggaaagaaaaattagtgaagatggaaaatagcaaaggccttatagaggaggaagcacgtgaatttcgcccttgaagactactgtggattcgatagtctaatgattgaggagttacagaagtgggggaagaacttgatcaacttgaacaaataggatgtaggattgggcctgatgtgtttaatgtgatagcagagaggcgatattaattaggaggaagtagtaaggaataaaatatacagttgtacaaggtttggagaggcatgcagtggaatttcaatttgaattcctgaaaagggattttagttcaccaagatttgagcgagatagtaatataggaaataagtgtttcataaagatgagtctgggagtgatctgcaggacagagagaaggtggagaagatggagttagccaggtgagcatacgatatggggtttgggccaccacaatcaggcatcttcttatttagatcatcttaaatcttgacttcataggattgttaccatttcaaaacataggctttaagtgactacttcattaactccttcattcaccttactatctttggttttattgtatacaataacttttttttttgaggccctggtgttaatcagaatgatgcatctttctcctctgtcaggctttcagtgcttcacatacttttcagatagtcttcagaactccttcaggacagagagaactgcttttcctatatgaatatagagagagctaaaaattcagaaatttgaagtgattatatgaggatcacccagcatgtcagtgtctccagtagaagtgaaattccagtctttaattcggagacaatgcccaatcactgtggctactcttagaaacaatttaagagaatcttcagacccacagcttaaaataactcacgtacatggcataaaataaatacttgggagttccttggatgcagggtgtttgtcttgattatcttgggtgccccttcagcttattatgggtcctggctcatagaaggagccctgatatgtttattaaatcagggattgatgattgggaccacctgggctgacctttgaacgacttcttacttcctatagtcttcaaaactgccagaggctggggggatagttgacaaaccgggggacgtgctatcctaatctgcagaggtgctatcctaaatcactgaccaattccagctttaaggttcacagaaccttttgaaaaacatgatctggttttaaaattgtttccgtgttgatccattttgatggggggtgaggttcgctattcacatcagtgagtatggccagcctttgtctgcggagatctgattagtttgttaaattcaaagtagcattttagacatgatttcagtaaaggttaggggcactctttggctcttaaattttaatagttttataaaaaccctcttcaagacaaagttgtaatttaatacaaaatcgtaaattggtaaacctgtaacatttgtatcatgaaacaggtgatgtaactgaagattaaataaatgtaaaaaatttagatattgcttttgaattggaaatggcaatatttgtatatttttgacaaagcttgaaggagcaaaatctcatgataaacactatatgcaattgacctgaatgatgtaatgttaaagagccactgcagaagcatttgcaaatcataaattaaagagctctttctcaattaacagttacagatgtcttctcagtgcagggaagtgtgctagggactgcatcctagagatacagtctgtgctggcatagggcttctaacctagtggaggtgacacagatacaggatgtagtttccaaagtagtctaccacgggtccagcgagagcatgcaaacattattaacacagggtaagttaccactgagtgctagattagtggattaaaatgacctttctacccctctctgcctggtgaacggctgctaatctttcaatgttagctaaagctcctaagactcctgtagacggtctttttcgaccccatacagcctttattctctgcggtactcaatgtgcgctgctttccaagcatttgtgatacctcaatgggcatagtctaccagaatgagtgcaggatggggaagtctgggactcccagcctcccagagcacaagaaaaacttgtaactgtcagaaatcagaattaatcgattaataatagcaaatattaagtaacaaatattaaggttaattttttaaatattctaccagccaatttagtctctttgttctaatttcatcttcaccaagcagtcttatggttgtacatttggttttctacccccttatgtggcaaaaatattgctgtgattgtggttatagcccctgctgtcagcttgagacttgatgtctgtacattctcctttgagtctggatccttgatcctggcctgtgattccatctcaggagttagaagcctgtggtgcctggcctgagtcagctcattagcttcattgacaacattggttcgttcaacaaatattgcctgagaagaagacatttaagcaaagacctgcaggaaggaagggagttaactaagtggatatgtggggcaagaacttcccagaatgaagaaacacccgcattaattgcttgaggtatgagaggtgaggtcaggggcaccagtttgtatagggctttctaaaacattatttggagtcagatgacaagctatagaggatgctgagtcaaggtggaaacaacaaaatcctacttaggttttaacaaaattactgtggttgcggtgttgagaatagtgagatggtggcaaggatggaagcggggagatcaattagggggctgtttaaatgatccaaacaaaagataatgaggtaattggatcaggtgatagcagtacagatggcaggaagtataggattggggaatatattttaaaggctatgccaaacaggccttactgacagatgggttatggagtgtgtgtgtgtatgtgcgcgctcatgtacacttgtacatgtacctgtaaataaaggagagaaagaacagacaaaggataaccccaacgtttttagttgagaaattgtgttttcacacacactgagatggggaaactgagagcagcatgtttgatagtcaacgttaggagctcacctttagacatgttcactttgagaagtctgttaggtagccagaaggaactgttgcacaggcatttcgatgtacaaatctggagttatactctgtagaggtccagattagaaaaaaaattggagggtcatcaatctaacaaaaggtttaaaaactgtgggaatgtactgggtgcagtgagtcacatctgtaatcccagcagaaatgaagatcatgctgtaagagagtgggattacaattgacctccccatgtctcaggttccacatgcacagattcaaccaattgtggatcagaaataggtggaaaaaaaccaatacaacaatagaaataatacaagtaaaaaaatataactatttacgtagcatttacactgtattaggtactataagtaacccagtgatgattggaagtgtacaggaggatgtgcatgggttatttgtaaatactatgccatttcctatctgggacttgagcatctgaggttttgggtattcttggtgggccctggaaccaatgcccgtggatcccaagggatgactgtatgcctgtacgtgatgatgggcctctctccatgaatttaagtcaccaggactgggtttggggagtgtcagctcattttctgcctgtttatcagcagacacagatggggtagttttctcacttgcacctacggaaaatcctccttgctcctggggttgtttgactcagtgtctcccttttcttgtgtctgggaggttgatggcatagtacatttactccccaagtagtctgtgagtgtggttggttaaggtggctgaactgaactcggcatctcccagcaccaccaacctggaaagtgtttttggtaggtgctgtgtgtacaacatccttctgattgcaaaggcctgtactctagcattaggtcgggttaattcctgtcaggtcttttttttctcttagagccccatttctaatgaagggattaatttggcaggtgatatcaacttgcaagccaaatttagagttgattttccaaatgacttctcccaaatgccctattatttcctgtctccattgtaaaatatttcttcttcctggaattctctaactccctcttctttgagaaataaaaaaatatcaattttagtgtaataatttgtcttatttaattttgttacttaaatatcattcacattttaccaagcacttaaaatttggataggaatagagattgagataatatagctctactctcaggtaattcacattgtgggccaggcgccgtggctcacacctgtaatcttagcactttgggaggctgaggcaggtggaatcacctgaggtcgggagtttgagaccagcctaaccaacatgcagaaaccctgtctctactaaaaatacaaaattagcggggtgtgatggtgcatgccggtaatcccagctattcaggagctgaggcaggagaattgcttgaacccaggaggtggaggttgctgtgagccgagatcgcatcactgaactccagcctgggagacagagcgagactccgtcgcaaaaaaagaaaaaaaaaaatcacactgtgacctttataggatatctttttactgtccagttttacatataatttaccatggattttttaattaggatacctattttattgtaatctggcaatatttttcacatattggagataatttttgaagtcagttctttgtctatgatatattataacttccatttaataatcattggttttagattggaattgtgtcagctccctttctataacatatagtttccatgtataaagtaatctgagtatatatcttatgtgtgagtgtgtctctgaatttttttcattgcagatagtttggtggaattctatttttagttatgttttttctccatcactttgcttgggaacgctggatgaagtggttactttcatttctctttttcaccatcatgattgtttcctgcagtcccatttatttttgtcaagtttttcttcatgccatcaatctgtctcatttgtgtatctgttctgtttctttttcttttttcacagctgcgaagagccatggatggtcttttatttggttggttttcattcctgatgcatatacaaaccactagagtatgcatttttgaatcttatatatatcttccagatttagctttatattatgaagatatttgtcatttgggcagctgagaaaggctttttccttgagacactctctgcttaccttttataatgttcagacaggaggttgtcagttaacttgctataaatctaccttcagcttcagtgtgatataattatataagttctattattaatgatgcatttctggtttggtctgctcttgatagtgctagtggtcaccagccctgctattttggcatttatagtgagcacatatcttctgataattatatttctcttttataaaatgttttatatacacatttcttttaatgtgtcagcatagcaaatattttccaaatgtccacaacgtctgaggcattgttgtaagcaatgggaatgctatggtaaataagatgccatatacaaattacattctagtgtgggagagagacagcaagtaagaaagacacttgatagagctgcagagtgttgagtactgtgaagaacacgaagcgcgatgtgaacgtggagatgaaggcatgtgctgtggtcatggaaggccttttgggggaagtgactttcaagcagagacctgattgatatgatgccatgaagggcagtttagggaagggagcagcaagtcaagaggccctgaggctggagtgtctcagggccagcaagaaggtcagagtgcctggatgatagttggctagtgggtgagtggtaggagttgaggctggatcatagccagttagagggtgagtggtaggagatgaggttggatgatagtcagctagggggtgagtggtgggaggtgaggttggagggatagccggttagcaggtgagtggtgggaggtgaggctggatgatagccaactagggggtgagtggtaggaggtaaggttggatgatagctagggggtgagtagtggtaggtgaggttggatcatagccagctagagggtgaatgttaggaggtaaggttggatgatagtcagctagggggtgagtggtgggaggtgaggctggatgatagtcagctagagagtgaatggtaggaggtaaggttggatcatggccagctagggggtgaatggtaggaggtaaagttggatgatagctagcgggtgagtggtgggaggtgaggctgggtgtcagttagctaggggttgagtggtgggaagtaatgttggatgatagtcagctaggggttgagtggtgggaggtgaggttggatcatagccagctagggggtgaagggtaggaggtaaggttggatcatagccagctacggggtgaatggtaggaggtaaggttggatgacagtcagctagggggtgagtggtgggaggtgaggctgggtgtcagttagctagggggtgggtggtgggaggtaatgttggatgatattcagctagggggtgagtggtaggaggtgaggttggatcatagccagctagggggtgaatggtaggaggtaaggttggatgatcgtcagctgggggttgagtggtgggaggtgaggctgggtgtcagctagggggtgagtggtgggaggtgagcctggaaaggtagcagaagtgatccaggatcctaaggtgtgagaaagtgcttagattttattgattttcttttaggcataagagaaggccatggaggattttgagtagggttgggctgtaagcgtgtttgcatttatttacaaaaagattactctccttgctgtctggagaatcaaccataggattgcaagagagatcacgtaggagattctcataacaatctttgtaagtgatgaaggcagcttggattgtaggatcaccctgaaaatggtgagaagtggcagggcttgggttttattttgaaggcgtaatacacaggacttgataatggattagatctgcagaatgagggaaagaggtgaacctacattttgccctgagcaatggggtgaattgtgctatttatgaaaaagtggaagactcagagagagaggtaggtttggggctgaaaatgagccccatttgggctttttatgggctcttcctgatctccttctctccccttgcttttgaggtattaccagctacaggggctgaagaaggagcaatcaggccagggtttaaaggggcactgggactgagccagggaggtagctagcatgagtggtaagttgtttacatgcaggggattgaacaaataagtaaatatattgagggtaaagggaactaggtttatcatcaacagataagggatttataaatgtggaaaggggaaagattaaaaagaaccttgaggtgttagactagaattggaagtattaatgtaaacacatggttttggaaacatgtatatataggtgataatatagagacacactcatatacacacccagaaggcctaggagcagtcaatcacttatcagcagtgagtttgccaactgcctagattctggtttgtaaattccatcctctactaaaagggaagggaaccaaggctccttgaaggaatagttaattccaggataagtacaaaatgaccttggaaaactatctgtgctagaaagtaaggaaacactcagaatgatgggagcctttcaagttacaggtcccagcttgaagggactctcactggccaaattttggacaatttgagcaagagagtaaatgatggcgatggatatacattaaataaatgggagagaagcaaagtttgttgttgttgttgttgttgttgtttacggtagaatggctgaggaaggaaggagtaatggagtgaaaaaaatcaccatttggcaaccactgtggtggtggttggttcaagtggtagttattaatagacactaacgttggtgtgaggatgtttgatgagaaacagaatattgatgtagtcttgagatatctcccccaaaacatgtattaattacagagggagagctggtgaccaggtggtcgaggggtgggctatgctcacatcacgtgcctcccaaggagaaatactgagatgggcaccgcatccttgctgacaaaattgtattcctgacgacatcccagcctgagtctgggtacgagaaaacactgacagactctggttaggggacgtggcagagagggacaggcctgaactcttactattatgtgataagtacctttgtggatacaagtctgtatttaagagtattccttagaatagagttctaagaatgtagtaactagatcaaagaacaagaaattttaaagactctcaaaaagtataatcaaattatgtccctaaacctagcaccaatttatatccacactagtcatacataaaaaggacccattatattagctcaaaatagcagtgagtttatttgcacacattttaaaataaagatacaataaaccatagagccttagaaacgacccatttcaacttgcctgagagtaggaattagatatttctgatgcaagaatatcatctgtggtatccttcacagatgttcctcccaccccccgcataaacattttcaatgaaagtttatggattttatgtgtttcatggtggctaaatgattattaaaattttagggcttcccaaattactaaaggaaaatttgtcttttgtaatgttattaacctgtgcaataacctacagaaaacatctactgataatgggttctcaaaatgtaaggagttgatagaacttaaaaattcactcatgctttgtaaaagaaaaatatattgatagaatgaacaacagaaggagtaaatagcatttctgttgtttatttgtgataacattaaaaatactttcacatagataggcatgtgaaatatattatgtattaatatttcagaattattgtgaatatgaagttagcttatgtacataaataaggaaaatgtaggccaaggtagctaaatgcaaacacagaatatcagcattcatttacctcaggagaagttactagtgagtctttgaatttcatctgtgaaacaatttgtgtgataacatattttctgaaagaattaatcacttatttccctatgcataaaaacattgtccacaagtatccataggtcaagtctaaatatcattaaaatttgatttgcagtgagaagtctttatcgtatagttgataacgtctgttgaattttcattgatttggaaatgatgtggcttgtgtttggaattaagctattagaatattctgtcactataactctgcttcatataccagtgaagaaatcatcattcatttaagagtctaacaagatttgactaatatgaactctgctttgaattttggacatgttcctgattgtcacaccagaataccaccctcaaactacatagggtttgcagttgatcttcagtgtggaacttttgataagttcacgtttttacttgatcacatcgagcatatttggggttgatctttatctgtacgctatgctaatgcttaacataagtcctttatttacccttggttttgtattgaaatgttcacgcttatttcgacttaggttatttagtagtaagaaatatgacagacattatcttcatttgaaaaataagcatttgaaaatttaaattttttattttcttaaattttgcatattgaatttagctaccatgtcctttggactttttcactgagaccccagttttcccagccatattccgagtccagcccagtagagaatgtagtttggttagaacatagtgtgtaagtaattaaatttgtgccactacctaagtatgtctcagatagtcaaaaataagtgatacaatgtattcattatttgctatcagccatactattttctcccacattagtgtaggttattgattccattatctatttttgtcgcctcacctaggtaatgacaataaagtgatacatgggagagtttattcttagaaaaggaatgattttgggttactatttatgatgcttatctgaacaatgtaaagtgttacagagtcatattttaaatatacaaagagttcataaggaatactttgcggttcaggtaaaaataagctgtctagaaattaagtaggcttttgttttaaacttgattcatttatttgtactaaagtagcaggttcagtaacacaccatttatctggtcattttccagaataagatggaattttccaggtaactgatcataaattagttttccaggtaactgaatcttaaacttcaaggactgaaatcctataaatttaactattgttgatggaaatttttgtagaacatactttctaccttcttacttttctgtatcttttcaatcagaggatactcaataaaatttgatctgttttctggctcaggactactgttttttccacctccagtacctcttctttctcccttaatgagtttgctttttattcccagtggcttgtgaacccaaagttgttaggaattgttgtttctggtaagccaggatccagggaggctcagagtgagggtgtagggaagaaagagtattctttaatgttggtcttttttattagttgttatcaggcattcacatcttcccactttggttctggctttggcgctttgctctggaaggctgcttaatgggaggtcactgactcctggtacgttaggtctcacctggtagctttgcctcctcttcatggtggagtaaattgagccctgagagtatcatgggaatcactcaagctcacacacactaagtagtgatggaaccctgggtttaagacccaagtcttctgtctgcaagtctagtgttttcctactataactgtcatgttaactccaggtcattattaggaacatagttagtagtcttgataaataaagaaggctctgttatttcttagtgggattcttgcctctcactttcttacctatgttggaaactagagtcatcctagactcctctgcactctgcattcgaagggtgactaaagccttgtctagtttacagcctatgcagcctctagcatcttacctcctctgcgttcttgtcacatggccctctttcaggctcttttcgtctttagccctctttccctccttgttctcctccctgcctctggactcattgtcaaacacaccatgcatcggcactcagaaaaaagtagcaaaaacatggtagtggagaggagagactgtacaaacatgaacagctgaagggcagagaataagtaccaatgagtagaaaaatcaaaacagtccaattattctatcaaattatacatgtattagatcagaaagaaaatgattccagcactgtagccaacctaaaccatgtgattcaggtggagtttggtacagtgcaaaccttgagtgcatgtggtgtgtaacagagacatctctcttaccactctctgaagattaatgtcactcctgataagactctgattagaatcctatttccaacatgtggtgatgctaagtaaacagtactgacaaggctgaaggatgtgagctctactaagtgaattgaaaagttggataaaaagactcgctgataaagatgagaggacactgattactcatgaaaaggaaagaccaagggaggacttccatttgacttcaaaataacatgaattttattattctgatagtgccaccaaaataaatcctatgtattctccaggcagtaagggcttatgttataggcattgttttaaatgtaaatatttttatcaaccgaatatatttaagatgtgaaatcagttatccctataagtctgtaatgaaaaatggcagtactgggtactctgtttatccttaaaatttagaaattcatgttctgagaagtttttttggtattatttctttgataactttcttctctttttgtcttttatctcttttaagaactcttgctagtttcctgttgaatttgctggattgatcttcctgttttcatctatttttctttcatccatctctttggctgcttcccccgccccccattccttgtttcacgataattttttcttagttatgtgaatatattcaatatatttccttttgctttctttgttgcctgtttcatcttccatttattaaaaaaactgttattttcttgtaaaaacccttaacatgagatctaccctcttagcagattttttaaggtgtacaatacagtattgtgaatataggcacaatgctgtatagcagatctctggaacttgctcatattgctttattggaactttttaccttttgattagcaaatccctgcatttggcctccctgcccgacattgttctgttctctgcttctatgagtttcactattttaggaagctcattgaagtgaaatcatgcagtatttgttctctttgaccaggttatttatctccctgagcataagtctcaaccatcttgtcacatattgcaggatttcgctcttttttttaagttaatattccattatatgtatatactacattttctttacccattcatctgtcaccaggcatttaggtgcttctgtgtcttggctattgtggataatgctgcagtgaacatgggagtacagatgtctctttgacttctcagttcctttgggtacatatctggaagtgagattgctggatcatatagtaattatatttttaattttttgagaaacctccataccattttccataacggttgtacagttttgcattcctagaaacaatatatagcattcaaatttctccacatcctccccagcacttgtctttttttttggtggtcccatcccaacaggtgtgaggtggtgttgcactgtggcttagctttgcatgttactgcttccttttttatttctctcggtctctgcctttcacactagaggctttcctcggttgtttgtgatacaggtgttaagaaattacttaggtagatagtgagggtatggaagtcctcagtaaggttttccatttaatgaaaagcagccccaaatcattttcctttctaacagaaaaatctgtgaaatcaagctggaaatagatgccggcagttgtgccaatcatgttcaaaatggtggccccatcttcccttctctttatcagccacgtgtacatgtacagtaaggagcagacaagacagcgccagtcagtggacagctcatttgcataataagattagggtggggtggccagccttccccgtgggctgtgtaaatgtcatgcagtggctcactcctgtaatcccagcactttgggaggccaaggtgggcggatcacctgaggtcaggagttcgagaccagcctggccaacatggtgaaaccccgtctctacttaaaaatacaaaaaattagctgggcatggtgatacgcacctgtaatcccagctactcaggagactgaggcaggagaattgcttgaacccaggaggcggaggttggagtgagccaagatcacatcattgcactccaagagtgagactttgtctccaaaaaaataataaataaagaaaaagaaaactgttaggctataaagagtccctttgtttatctgttagcttaatttaaaagtaaaacatatactattctaattacatgcattaatgttgaatgttaccttcaaaagtttatagctcttatccctaatgccaacaacatctgattactttgcaccatatggctgcagtgtggtgtatggaaagaaagctggctggggacccagccaggctcagtcatactattctttagtagtgtgaccttatgcaggcttcttaacttctttgcttgaaagttttctcagctgtaaagcgcgggccttctataacatggtcccttagcatccttatatttgtaatattccctcattgtatgagaaactatgtctatattggtcgttctttttcagttagtaatcagatgttttctgtgtatgtatatgcgtgtctacatacacagcgtggttgaaaatacataaatacatgtagttaaaacaccacccccactcaaaatagatttaggctatatttgctaatggatcctcataagttcttgcagatattctcatccatgtgtcaatatttgcacataaatcattatccaggcactatatcattttttctcacatcttagaaatgcttttatgtaaacatattcctgaacatatttattactagtcaatatctagtactataatttataaattaataagaaatttaagtttttatttttttatctttttttaaaatctaattccccccctgcatgtttgacttgtgctggcagaataatttttttttttcttagacggagtctcactctgtcgcccaggctggagtgcagtggtgcgatctcggctcactgcaagctccgcctcctgggtccacaccattctccagcctgagcctcccaagtagctgtgactacaggcgcccgccaccacacccagctaattttttttttgtgtgtgtgtttttactagagacggggttgcaccatgttagccaggatggtctcgatctcctgaccttgtgatctgcctgcctcagcctcccaaagtgttgggattataggtgtgaactgctgcacccggccactagcagaataattttttaaaaaatctatgcatggggctcgttggctcatgcctgtaatcttagcacttgtggaggccaaggtgggcagatcacttgaggccaggagttgagaccagcctggccaacttggcgaaaccctgtttctacttaaaacaaaacaaaaaaaccccacaaaaattagccaggcatggtggctcacccctgtgatcccagctacttgggaggctgaggcacaagaattgctcgaacgtgggagatggaggttgcagtaagctgagattgtgccactccactccagcctgggcaacagagtgggactctgtctcaaaaaaaaaaacaaaaacaaaaaacaaacctatgcattgaaaagtgtctgaaagtaaataaagcaaatgttaacaatacttgtattcgttggaatttgaagtgatttttctgtgtatttaatatttttaacaattgatattttattgggaaaaatccattttaataaaagtaccatgctattatgaagtaattatgaatcagtagttgtttagttgaattataaaaccatattctttattgactattaaatcacacatcattaaaaatatttttttcttcaatctctctatttttttaattgaagtataatttacacatattaaaatgcacagattttaactataccctctgagtcttttacccactgtacttaaaatataaaacattccagtaatctcataaaattcccttaaatccctgttatccctcttaaatcagtccattccctcttcgcagacagctaccgatctgatacctatcatcatggattagtgttttctgtttggaacattgaataaatggaactatgcactcttgtgtctgactatcccattatccatttgatcactgcttacagatcttatgactgtcttaaaatacccattgttcttcttttcttaatgtctatgtaactggccctaagtcacacagctgggaagtgctagagccagggcctggcctcaggtccatgtgcccctgagctctttcccctaatcctgtgtgtgccgctttccaaggcccccgactggaaatccgcttgctggggagggttaggttggactgtaaatcactttgtcactctaaggaatttgttccttattcctcatatatggattctccattgtggcaccatgactctttggggttgaaaagaataacaaactgcaagcttgtttaaaaaataatccagtttttcttcagtgactattcatcaggcagcagctgtgagtcagatactgttctaagcaggctgctgactgcgccctggatgtgggatgatctgtctgtgctgtggagtccaggaacttgactcttgatgtgtcggcattttgaggtgtttccccttgagctggtcaggttccctggagaagactgtattcctcttctgcctagaaggtgatagcctggctgccagtgttcaggaagcagagttggggcctccgtgcacaaatccaggtaatctccctgttttcagtgaggcatcctggtggcagataccccagagtctccctctgcaaagagtgaacctccagtgctcctccagggtggagagggcagtcacctagtttgcatgtggggaaagggatccaggcactgatggtttttttcctgcctttcgtggagtctttcttattttggctctcctgggtgggaagacatgacagaccacgtggccttagtccccacattataaggaataaaatccagatttcttagcatgacatccaggatgtcatgggtgggtaggtggatggggtggggcagattttgtgttggcaattacattggccatttgtttgtcccattgccaactgcggctttgggcctcttgggtcagctttcacacctcccactgctgtgatgttttccagctgtccgcattttgtcttttcttgtgtttccacctttaaaagaaaatcctgtgctttttttttgtttttaaatcttggaaggcctttttgaaaaaatcagttcaggtataaatttcttttcattaattttgccttttaatgtatcctcttcactctgaggcaagttcagaaatctgaatttccttatttaccgtgaatcaatgtcatttcgactccaacacttgcctgtttccctgtcagcaaattatccttatttatgcttaaggtaaatctccccacttacctaggcaggccaatgctgtccatatcttggattccatgttaaggaatttgtattttattccttctaatgggagaactgaccaagtccacatggtttcctcgtgtctgcccacccggctacttctgtgccaggcttagggcacaggagtttatactctctatgcaaaccccagaacttcatgaacctggagtgggggcagaaaggcccattcaggcccagatcaagaggaagtcactctggtggctggatgacattttaagtaatagaagagggccaaagaaagtgttccaaaagcacacttatgctgtcggcatgattttatggttgtccacacaaagaggcagacggaatcttcttgaaagttttttgctggattccttttcttgttcctgtcccatcccccaaactggcatgtctcttcaatgcagtcactaactagtgtggctcagttcataggaaagagtgtctggttgttgtttgttgaatactttctgcgatcattatgcagacaagaagaccaaaagcagacagattatattagctctgtcttctttcctcatgccacctgtttgccaggttggtcatattttctatccccaagttaggggctgtggggagatggaggccaggggatctcacttggacctatcaaggagttggagcatggctataaatactttttccagttgctgcttagtttttagcaattccttcaaaactagatagagagagttggtgcttagtttttagcagttccttcacaactagatagataggtaggtagatagacagagcttaaaacaattattagcaagtttccatgggattttaatgggaaaaggagagaggaaatgttgggcctttgcctttattacctggagtacgcagaagagggtttcttgaggaagttttaggctagaacagctgagtttctgcccgccttgaaagtccactatcagagagatccctgctgcctggagctcagtggagatggatggacttgcctggctcattaagagcagggccgtatcacatctgtctttcaaaaccttgcatctgacataattcgtgatgtgtaataggtgctcaataaagggttgtagattgaatgactaaatgaggcagcgatcaccatggcagtcatccacatcagggtgagtagtggaaatgaatgaggttaggaagaattattgcattaatttttagggctcaccaactcagtgcttacaggatccaaatgaaagaataaacactgcccattctaggatgataaatgacagccgaaatttggcctcagtataggggcagagagtggcagcctggagggcacatgcctcatctgatgggagctgttgccagctgcagccagtaggcataatgacatacctcctaattttttttagatttaagtaaaactctggatggtagtgtgaaatatctttacttttcatttcaaatttatgatattttgagtcacaaaaaaaacacatatgtggatcacatttgattgaaggccttctcattgtcctctctggtaaacccaaaagaagagggaggccgggtgtggtggctgacgccggtaatcctagcactttggaagaccaaggcaggtggatcagctgaggtcaggagttcaagaccagcctggccaacatgacgaaaccccatcactactaaaaatacaaaaattagccagacatggttgcagtcgcctgtaatctcagctattcgggaggccgagacaggagaatcgcttgaacctgggaggcagaggttgcagtgggccgaaattgccccactttactgcagtctgggtgaaagagtgatacttcatctcaaaaacaaaaaaagaagaggcctgggttgctgggaaccttcatttaaggggcaagtggaagaaaaataatccttcaacaagactgaaaaggcgcagttaaagaaccagagagagaagtgactctgaatctaagaagaagactttaaggaaggctggtcaaggttgatggacatctgctatgatatgtgctatggggaagtcagagaacacagtgaattgcttatgaatgcagggagaatgcacattcacatgcagctattttgggtctgacacaagcatggtgcagtctgtgacactggtatcacttggaccaaacttgcttttaaagttgtttccataaggctctggcaagaaaagagtccaagatcatataaatttttatgttgaaagccatcattcgtatatctataataaaggactttaaaggagtatttaaaatatttcaaggaatttacatgaaactgtcaaggaatcactatttttatatcttcaccatgatagggtggaccttcgtcttgtcttttgggggaagttatgacagtagatcctattccaggaagttttattttactggaggaaagcccagttaaaatcccagtgttaatttcctgtcatgttaactaccaaagaacagatttccaaagtgtctcaaacatttgacacaatcatttccgttttctaaacttgatctgtgtttcttgggtgatacatgcattctgattcgaaattgaacaaagtatattcttaagtataactatatcctgtctaaggcagtggactcatggagtatgttttcatttttatgttaattgtcgagagtttataagtcattgtaaattagtctgagtgctttgtgtgagttagaaattgtctagtagagcaaaacccttttactaaactcctcctgtgtgcttccacttgctcagagccatgcaggcaacttcttacatgcagaggagggcgtaatctaagccatacgctggtcattgggtggacttccatgcctctatgcctttctcatgtgtgtttgcctctgcctgtaattttccatccattcccaacctcttttccttctcttccttcttatgaagtcctagttatgcttcagggatgatttaatatgtcagtccttctgtagagatccctaagaccttcttaccactgtacccatgaaactttatatataactatggatatggcacttatcaaataatatatttggtatttatttttctcttccacatgactgtgtatatcctaaagtccatgtcactaatttctgcatctaggcatgtatctgacataggggagcttttcagtaactgatggttgaattaggtggaattcctccaataagacatcaccccaatgcatgacttaggcaaataaggtattaaccctgtgtggtgttgaagaaccattaagcttaagagtattaaggagctaaatgccctcttatgttttgttatgtaatttaaacagaggaacaaaaaataaaattctttaagagaagaaggactagatatgtccgtaagccttgataaactaattataaaacttgtgggtgcagcacatcaacatggcacatgtatacatatgtaacaaacctgcacattgtgcacatgtaccctcaaaattaaagtataatgatagaaacttgacacaattatattttaacgtatttcacattgatttaaaatttaattgtcgataagtcatcagcggcaaacccaaactgtagaattttaattcccaatgatagatttttctaatctgtagtagatttcttattatgttatggcctgatacacatagcttagatgtgccttgagtaaaatcatgaccctgaaatctagcgactgtagatgttttacatattagaacttagggcataatttttctccccaacagcagggctggaaaggtgattacatttcagaagggtcctttcagcctgtgccttgtagcgatttggggcatgaccctttgctttacacctgcatagctggtgtggccttttctcccaggctcctgggctgggcctttcctctttcagagagaaggacccagggaagaggggctgaaatgggagacatcgttgtgtgccaagcataggatcatgcctggcctatggtaggttagcatttaataagtgtttatgcaatattgcttgattaaaatagcattgatcttttaatcaataacattattaaaataaaaatgttttaaaatgttaaaaatattttaatatctttacaataactattggctatgccttacagtactattgtctctctttaaacctctcttagaaactgtgtgttaggtttggttttattctttgattactagaagtgcttttaaagaaggtacagagctctaaaaagggcttctttcaagtgtagagagagaaattagaaaaaacatcaaagacaaagacttctaagaaggaaaataaaaattgatttaccttcgctttagaagcttcccaaaaggggagactaggaaaaatagcagaccagaccatactgaaggcttcctttattccctctgttgtctcattccctggtgccaagagcctctttggggagattacactttatggcaaggttgcatttgttgttattttgttctcatctccatctgggacaagcttaggcataattcctatttgtatttcaaattttcctgccaaaaacgtgttgacctatgtctccaaagtaacggaggttatgcatcatttctactctagttgtggaaatcgacaaaataatgtttctaccactagcaagaaaaattgagatgttactgtagagaacttgccattgaaatggcattagtgataggatttgacgttttgaaaaaatagatcccattcttcttggcttcctgttatactccttgcttaatttctgtttcatggacgcgatcactatctgttgcaagtgtgaggatgaagccacagatggctagactctgaccccataggggagccattcttactaaagagatggctcttaagaccaaatggagcactggtagaatgggtgccaggtgagtgggagagactgccttcctcatggtctgctcgtggctggtaatatccttgcaggggccacctctactcgtagggaataaggatgacacatagccacataaaggcaggtctggaaactcgcaagatgtccacctgcttacttctgagaaaaaaagtttggaatggtgcactctgtatgtttctcagcaggcagagcgctgggtttgttgagtgagattgtgttacacgtactcatagacacaggcaggagttacctggacttcatgtttacagtgtgttttaaattctattgatgttcgtatgttgtgaattccattttgggtgtattctgtacgaaaggatgatcttttcagagtatgtaatgaatattaacttcttagtgacttcagaagacccatttattggttacttgatagtacaaacaccaacagccatctgagttctgtaaattgttactgagatgagcttttttatttttgaaaaacgatcatttctctatgcatagattattatcactggccatctctactactgctcaactgaattccttcctcaaccataaccattgtgtagtttttatatttgattattttcctcatatatcgttatccttgactaaaggcctttctccttaggaaatgctttagactacctggccttatagcatcaatttcatttttaaatgcctgtggagacatgcttgactgcatatgaattttctagtagagttctgtaagaattcttcacctcccaaagaccatatgtatccatcttggttcccaacagtttataactgccagaataatttaaaagacattttccctttgcaagttaatttagaatagaacatattttgtcagagaaagtggtgtgggaaacagcttggatcaagcagccacagacctctagcgacctcacaggcagcatggggcctgtagagggcactgcaccaggagtctgatgatgtggcctgggtcccggccatgcccaaatgaggggcgaagtctttcccagtcacttctgctctcttggcttaagtttcttcacatggaaaatgagtcgttggcctaatgatgccccaaagtagcgtttagattttaaaatgtcattgattctagattttaacatctacaagttcaacatgaacgtcgacagctcatttagtcttcataatcctctttgtaccaaagcagattttgtgatcgcattctgaaaacatcaggaaaactaggatatgctacagcacttaccaaccataaaatcaggaaatctaggttatgctacagcacttaccaaccaagaaatctcagtggcttaaagcaagtttatttcctgcttagggtgcacagttagtgtgggttgagtgaggtgtcactgctcgtcacagttacccagggactcaggctgatggagcagctgccatctcagatgctgctgatagctgtcagagggaagcagtatggtggatttgtataaaactcacggactcctgagccttgtactgtaactgagtccctaacttctgcctgcctttcttttctgcagcaggtgaccatcactgatggagggggcaggagagtgtgctcctaccaggactgggaggagagctggtgctatgtggtgggcggcagtattggcaccacatgttacagagggctgcttctgaccaaagccaactttaggagagagttttaattgacgcctaacagacctttgctgggctcatttccatactgtgcccaatgagaaagaactatgaggaatggggaaaaggcctcaggtagaaagtagagaagagtcatgggattgatgcaggggtcagaaaaatggtggggcacaccaaataaacattttggcaggcggtcaaaaggcctagagttaatggctaaagtgaggccaagatgatattgaaaatgttcatctttcatgttgaaagactaatgtgcagtcacttctagcatgatggggatcgtggttttcctcatagctgtcccctgtagaagtctcagttactcctcatccttcaagacttaatgcaaatatttatctgcgtgtattttcttttcctactgaaatgtgaatgtttccaggacaaggagccatttcatcctagcacctagtttacaggcactaagtgaatattacatgattgaaatgaaaccacctggcaaccctctgctatggtgcccatgtgcctgccatcctctggctggttcagcattttaccaggccagagctgggcacagaattggttctgtagaagcagctaaagcaagatgacatttctgagacttctggccgctgttctgttaattttggtgctgtcaagcgaaagggtaatcaaatagtactttgaaatctgaaaagtgaaaagagaaaagtaaactcatacctaaaatataatttctgttctgtatattctagtttccttcttttgagttgctgtccatttagtgtagtgcaatcaagaatacctaaatcagtataacctcgtcattgaaagaaagactttagtaacctattgatatttctgtcttcattattttattattatgaaattgctgaaaataattacacaagtgatataacttttaatcgttgggatgcaaaacagtggttctcaagcttcagagtgcctcagggttgcctggagggcttgctggggccccactcccagagtgtgcatttcaggtggtctggggtggggcctgggagtcagcatttctgtggagttccctgaggatgatgacaccgcgggtctgggaaccacactgtaacgaacaatgatgtacaggaaagggcactggaaacagaaaagcatgggtgtgaatcctccatgctccctaataaccatatgacagtaggtctctcggcccctctaatcctctgtttccaccttgtggaacgtgaaggccctagttgacctaacagatgatcagatgaggttgtacactaaagccgtttttaaaaaaataaggctctctgaaggtatcttcttacaatatcctacagattgagaatcatggacacttgttttacattcagagtatacacagctctgtaccaggtagtggaaaacaggacatggaaagaaaaagagaacaggagaaatgtggcacatgccaagcaccaaaatgagtgatgtgactgtttaaaattaagagaaagacacgctgtggtgggctgcccaggggggacgtctcccaaactgtactgcgtaaagaccatcatttcacaaggaacctgtggtcactttgtgttccaggatggcttattgcacgggtagcgtcctggaatctagaaatctctcatattagtgcatttgggtagtttatcttttcttggactcaatctcaggttacctacccgttagagtttatgaagttaagagtttaaagttcctcattttgcaagcatttaaaagtcatcatctcaacaaggaggtgctactgtaaatataagtatcagaaagatctatgaagtcatcttttcacacttttgatttaactaattgagggaggggaggaaaatctgaaaatctcaaggaatttttaatcttaagattaaaaaatgtagctcatacatagttgaccagcactagcatttttcttttaaggtgtgtgaccttgtctacacttagagttttagataatttttattatgatttaaccctaatgttttaaaattacaattaatagtaggtttagaaattaatgttgtaagtaatatattaacatttttactctactttaagtgctttgatagccacatatttaaggttggataaaaactgtaatttaacagtcataattattataattgatctgaataaaaatatgaactaactgtattggtcaaagcaagttatgtggtaaataaaaattaacaataaaattgaggttttaaaacttaccttgggcaaagactgtatctgggtgatagattgagctctagacagtgaagtgtacctatggatactaactgccgttatgattaataaacacgttgttatacttcaattgtaatagcattttattatgtattatttttcaccaaagaatactaacaggccagttaccactgtgcaggttctgtttaaactcttggcattaaaaaaggaatcctcattcatacttgaaaaagattggaaatccctgacctagtccatgcttgtccatgatactaccctggcccttcatcttgactgactctgtagatcactgttaatgttggtttatgtatttcttacccttttggatagataccttttctaaaggaagcaatgatggaaaactggctgttagctaggttgagatgtgtgcacacttcattacactcttaacaggcagatacccgtcagccttaaaggatgactttttgccaccctgctttcctttctgcctggccatctgcttcttagaatcttccctgaccatgctgtatgttccagtaccttctttgttgaagaacgtattggaaagcatagtcagtgtcttttaacctgattcttccttctgttcttttgaagacagctttgattgtttctaaagtgccaatggaaaaataaatccaagaatttgtctccccagtttttgaaaaattgtagtgtagggcaactgtaaaacacatactatgtactataagtttcccacaattaaatcagtatgaatagttgttgaaatgcatcagttgaatagattagagattcaagtatatatgaagatctgaaatgtaatagacctggcaaaactcagttcatggaaggtggttgattcaataaatatcattgatataactgattatacatctggaaaaaataattgtaggaacccttcccacactgtatacaaaaattaattctagatgaattattgttctaaatgttctaaaaatacacaagtaatagaggtaggtcttaaacctgggtctgtcttactccaaaactactgagctacattttaaatgttaatagataatgcgagattacgagtcccaaagatgagaggagagaaacattttcttttgctaacatttgactttttattttttgtcgtaaacaatgctgagatgaacatcctaatgtctacattggtaagtggatacatgattattttctttttaacacattcctggaaatgaaatagctgtgtttgagggcacccaggcttttgaaataaacttccagattgctctccagaaaggctgtgctaaattagtgactttattcttttgtcatgtttaatatcccactatttttctcttcagaccatcttttgttatggagaaggattgtactcccatcttccttttatattggcaagtttctaattaacctagggcttcctgtgaaatagggagaagctgatattttgtatccttttatcatctatattaataagctcataaagaaagtatcactttgacctcagatatctccttctctagcattaatcggagacttctgttaagatccagccatatagaacaacaacagtagggttttactctccctactatcaatatattggctgtgctggaggtgaggcgccccccttcctcctgcagccagagagctgcatccctgggaagaacctgctcttacatgactttaactacttgccattcaatgtaagtgcagcatatttccaaactgcgtaaaaaatgagctgtgtgaaggcttcctcctgtctttgttatctttcatgcaaacagttctttttgatagaatttggaatttaccgaattcattccgaaggctgtgaaatgtgatctctatgagttatagtcttcctgtgaggatgcgttgtttttgtggaaggcaccaccgggttgacacagtattatttatttttctcccacatacttcttgtaccttcctctgtaaccaatatgagactgtattgaagagaaataatcttgccaagtatttgatatacatagaattctttgtgagttgctatcttaacttaaaaattttaatatgctaaatatccatgtgccaaaggaaaataaaagtaagttcttttcagagcagggacttttatgtcttacagtattcagtgtgaagtaggatagaggtatatcatcgatcacagtgcacaccagacagaatttagagtgtttacatctgcgatcagagttacctggtctcagggcagagcatgttttgttttttttccctactttttagcaaagacttaggctattgtaaataagctgaaaattatcacagaaattgttgaagttggctctgaacaagaatgcttgatctttctataaacagctttattaatgcacgtcaaggcactgttctctaccatttccttctgcttgttgcagaccagctaatgtgttaacagagatctgaatcatgacctttttttcccataggcataggccgactctttccttgagctaaaatttagccagaaaggaaaaaaaaacccattttggtgcatgtggcatgaaaatgaaacaatgcagctttatttagggtctcctttaacctacatcttaaaaatatattttaagtctgtaatatgcctattaaacattagcacagttatcaaaataatgatatttgtaaaatcaatgtgaatatgtgaaatttgtagctttatatacaaatcatatacatgggcatgcatgcatacatatttcaacatattaatatgtgtctatctcaatatatgcatatctcaaatttacatatgtatatcttatacatatataattgagatagcaccaattataaaggatttcttaaagaggctgcaaatttaggcatttgtcattaaataatcccataatatttcagtgcctgaaatcattctagcctttatattgtagtcatttgcgttttcttcccttttctaaatgtagtctccagatgaattaatatactcacaatcaacatactgtggcacgagtaagaactatgtgtattagacaagttcaaagcagtcctgacgctcacttgactaaggcatgtgcctcatgtcccctttaccttcagctcttctgggccactgctgggtgctcattgctgctcctgtgctgactgtctgcagtgtgtgccgtggaatacttctttgcctatttatcatatctttggttcctctccatccttaatgctgaacttttagagcatgtagaacaaatcagaagtctcttgtgctgattatatccatttgacagatgtgttcagaaattttcttgcactcattaaaatataaagtaaaaattgaaatgctttatatgatattaatatggatattactatgacaagtgatagcttacaatgaaaagatttcttttaagaactcttgccatatttccttctattttcatgttttgatatttctagaaaatgtttttactgtattcaagattagggttttgtaatttttagcaatactgctgtggagcctagttgaaattagtgtattactttagttcagactttcttcttatcattcttgattgttaaaagaaataaaggtttacacagaatgtatagcagtgttgagtgaactcaaccagcttttaatatattttttagaaggttaggagaaagattaacctatttaaggacctaacctacttttacatcctgcaaactattttttttaaattttaaaacatttttcgtttttgttcttttgtattttgtttattgtaaccgtagtttgtcaggagttacaacccggccaacaccgggggtggggggcccaacatcacacatctgtgtttgtaatgtagtatttattaatacaggtcatataacattaatgtgtcagcacctcatggatatgtgaattatttaaaatgagcatctgggtactattttttgatatttgaaataaactgaatttttaatgttcatatgttatacgatatgccaagattatcctggtaaagttttcatatccaactggggaatcagcagcaatgtttctccctcatttcttgggtcaagcaagcctaaagttggacacaacctttaaaatgagctgattatggacacatttatacatcattttgttaataagttgtgcatcagttaaactgaaagcttgctttgcttgcctcattggtttttttttttttaatttttctggaattaaaaccactgaaaaataagtccagaaacatcaatttggctgaccttagtttccccctaaatttagtagttttatacagcagaaaacttgtaaagttacttatttacagacaggctctcagtgtgtcacccaggctggagtacagcagcacgatcacggctcaccgcagcctgagactcgtgggttcgagcagtgtttccaccctggcctcccgaagagttgagattacaggcatgagccactgcacctggcctaaatttttttttgttgttgtttttaaggaacaattttctttacagaattatttagaattagaaattgtgaatcacattatcaagcttttaaaaactcttaatttaattgagaaaattaagtattaatactatggcctgggtcgttcgggttgtagtgtgatacaactcctaaacatgaaagattttactcttcttcttcttcttcttttttttttgagccggagcctcgctctgtcgcccaggctggagtgcggtggcgcaatcttggctcactgcaagctccacctcccgggttcatgccattctctgcctcagcctcctgagtagctgggactacaggcgcccaccaccaagcctggctaattttttgtatttttagtagagacggggtttcactgtattagcaaggatggtctcgatcgatctcctgaccttgtgatccacccgccttggcctcccaaagtgtggggattacaggtgtgagccaccgcgcccagctgattttactcttttgaaccctgtggttcctggaagttgaagtcctgtcccccagtagatgcttgttgaatgaatgctcactcagccactctttttgccagaggctactagtttctcacctacctcttctccctctcatctaggctgacatactctgaaagcaaggcagaatttgctcatatattcatttatgatccatattttttccttggaaataattattttcattttgctggaccacgttttagagagcctcacttctgttgatttgattctgagcaatgtttctgagctggactgaccacagagtaagatcttaccttattcatggctgtgaatcatattgagccatttgtcttagctgtcatgcaatttgctaattaggtcattctaggggttgagggaaatgaaagactttgaaataatcattaccttctcagaacaaagcagcagcagttaaatgcttttgcccagtcattttactctgatgttcaataaattcagaagtggaaggtaagttgggatcttactgttgcataattatgctttccagtttatctgaagattgtgcagaagatatttaaatcagtgtcttacacagttataagttgtatatttctgtttttcttattacattttttatcataaaactaaaacctattagttgaagaacatttggaaaatacagagaaatagtaaataaaaaatttaaaagtactcctcatcctaccatctagtataattatttgatggatttctttctggtctttcctattcatatatttttcataaaacttaattattgccttatattgtacaacaatagctgacattttctgagtgtctatttcatagcaggcagtgatctaagagctttaaatgcattatctacttaatgttcatagcaatctaggaggcagttattttccaatgatgaatctgaaacttaagattttgctctatgtcaaaaaatgagaaatttaagacttctagcttggacaaaatggcacagacctgtttctcccactttctcccaactaaatacaatgatagaccccagaaataatgcaagaaacagaaggagaactctaaaacttggtaggaagaagtcaagatggtttggggcccaggactaaaggactgacacaatggcagggcatctcacattccctcacccatcaggagaggcagacctggcctttcttgacctctgaactagcaaccgagatagtccagggaggctgcttcctttttttattcaaatggaagcaagcaagcagccaagggaaatactcttctttcttgctgagatacccttttccagtgtgtgatacctgggcttctgtgaagcaattgttagaaggatcccactgcaacaaatggtccagctgagtagcttctttgtcctcatgcacctaagaccaccttcttctgcccagagaggaataggtggttaggaaagcctaatccattctgtgggcctgaacaccaccactccttctactgagggacactgggcattaggcctggggaagtcccttcactccctcaggcagcatcagcagggacccgtgggagcccccatcagaaccagacaaatgaagcgggcacaaagaatgctgcaaaggctctgaaaattaagctggccctggaaccatagcccacaaaagtagaccaggacccacatactaagcctaaacagggtgactgcctagacaggaaatcagcaaggatgtagaaggtctgaacaacacaatcaagcaacaggactaaattgacgtttctggaatacttcacccagaaaccacagaatacatagtcttccaaagaattcgtgggacattcaccaagacggcgcacatcctgggccatagagcacttttaaacaaccaaactcatgcggagtgcactctctgatcgtagtggagtctattagaaatcagtaacagaaagacaacaggaaaaccttcaaacaggtaaaaatgaaacaacacactattaaataatacatgatttaaagatcaagttttaaaggaaataaaaatacataaaactgaaagcaaaaacagaacataccaaaatatttgggacgcaggtaaagcagttctgagagtgaaatttatggcactaaattactacattaaaaatgaggagagatagagaaagatagttcaatagaagcctccagagattgtactcactcctccataggatcaccaaattacccacagaaaaaatcatcttcataagaaccaagaatcaggtgagcaatcacagtacctggttttagcatcatactaaggaaagaggcactgaggagagtaggagagatagtcttcaatcacctaggccacctttccctcatccaaaaaatataactgataaacaaattcattatagttgctgaatacaaaattaacatccaaaaaggagtagtatttgtctatgccaaaaacaaacaatctgaaaaaagaaatcaagaaactaatcccatttacaatagctacaaaaaaatactaggaattaagttaaccagagaagtgaaaaatccctgtaaggaaaactataaaactttttgcaagaaattgaagaggacacgcaaaaaaatggaaagatattacatgtttgtagatttgaagaatcaatattgttcaaatgtccatattacccagggcaatctatagattcaatgcaatccctatcaaaatacccatgaattcttcacagaaatagaaaaacaatcctaaaatttaaatggaaccacaaaaagccaagaatagacaaatttatcctaaacaaaaagaacataacttgaggagtcacatttacatgacttgaagttatactacagagctatagtaaccaaaacaacatggtatgggcataaaaataggcaagttgaccagtggaacaaaattaaaatccagaaataaatctatacacctacagtgaactcacttttgacaaaggtgccaagaatatacattggggaaaggacactcttttcagtaaatgttgctgggaaaactggatatccatatacagaagaatgaaactagacctctatgtctcatcacatacaaaaatcaaaatggattaaaaactttaagatgtgaagattatgaaactagtaaaagaaaacattggggaaactctccagggcattggatggggtaaggatttcttgagtaatactctacaaatatgggcaaacaaagcaaaaatggacaaatgagatcacatgaagttaaaaagcttctgcacagcaaaggaaaacaatcaacaaagcaaagagacaattcagtgggagaaaatatttgcaaaccatccatctgacaagggattagtaaccagcatatataaggagttcaagcaactctataggaaaatatttaataatctgattaaaaaatggacaaaagatctgaatagatattttgcaaaagaagacatacaaatggcaaacaggtgtattaaacgtcattgatcatcagagaaatgcaaatcaaaaccattatacaacaaggtatcatctcactccagttaaaatggcttttatcttaaagacaggcagtaacaaatgctggcaagaatgtggagaaaagggaatcctcatacactatcggtgggaatgtaaattagggaaaccaccatggagagcagtttggaggtttctcaaaaaagtaaaaatagagctaccatatgatccagcaaagccactgttaggtatatatgccaaagaaaggaatcagtataccgaagaggtatctgtacttctatgttttttgcagcactattcacaatagccaacatttgtaagcaacctaagtgttcttcagcagatgaatggataaagaaaatgtgatacatatacacgatggagtatattcagccataaagaaaaatgagatcctgtcatttgcaacaacactcgttttgttaagtggagtaggtcaagcacagaaggacaaacttcatgtgttctcagtcatttatgggagctaagaaaagtaaaacaattgaactcatggagataaagggtagaatggttccctgaggctggaaaaggttggtgggggtgcagcaagtagggatggttaatgggtacaaaaatatagttagaatgaataagatctagtatttcatagtacaacagggtgactaaagtcaataatttattatacatttaataactagaggccaggtgtggtggctcacaccttgtaatcccagcactttgggaggctgaggcaggctgattatctcaggtcaggattttgagaccagtctggcgaacctggtgaaacctcgtctctactaaaaatacaaaaattaagccaggtgtggtggtgcacacctgtaatcccagctactctggagactgaggcaggaggcagtgagccaagatcacgccactgcactccagcctgggcagcagagtgagattctgtttcaaataaataaataaaaataaaataactagaagagtataattggattgtttgtaacacaaagaagggattagtacttacgtgatggatacccataccccgtttaccctgatgtgattattacacattgtatgtctgtatcacaatatctcatgtaccccttaaatatttacacatactgtagactcacaaaaattaaaaatattaaaaaataaggaaaggtctcaaatcaataatctaagttaatacctcaagaaattaggaaaagaagagcaaaataaatccagaacaagcagaaggaaagagataataaaagcaaaagtcgacaaaactgaaaatagggaaacagtagaaaaaaaatcaatgtatcaaaaacctggtcctttaaaaactttaataaaattgataaatctgtaacaaaatcgagaggaaaagaggacacaaatctgtaatatcaagaatgaaatgggacaacagtacagatcctaaagccactaaaggactcataaaggacaagattacactcacacattttccaactaagaagaaatgaggtcagtttgtcaaaaactgcaaactaatactcaaccaggatgaaatagataatctgaagagtcctgtaaccattagggaaatggagagagggtagtggctatggtcacaaaagagcaagaccaggggtcctgatggcaatagaaatgttcagtgtcttgatgtggtgatggacacaggaacccacacatgtgctaacattttatagaattaagtacacacctacaagtaaatatcaaactgaggaaatctgagtaagataattggattatatccatgtcaaagaaatcctggtcccagcattgtactaaggctttcaaaatgttgccattggggataactcagtaaagggtactcagaatctctttgtattacatcctataacttgcatgtgaatctgttattatctcagttaaattttcgattaaaaaaagctagcagcttgttactttaggagttgaaccctgactgtatgactccagagaccttgttctcattcacacgtctgcatctccatgttatgttgagacattgcattcctagtagttttacatgatcacatgtagatcataccatatgtaaatagaaaagtatgcttgtacattgtctttaacagcaattatcagtattagacaaagcatagttttgtttccctcccccaccccccgaccctgttcctgtctcatagtttgaagtttcccttaagtattcacagttatagtccccaaagactttagatgccacgtggcatgcgtaaagccagcatattctattgaaatggccggtatagttgccgaatcagatgtttttagcttacagaaatgacaatttcatatgacatttcttttcatatgttcaaagaaattacttgagcaaaatgggagatttctggagtaggccataggatcaaaggagttgctggaggggacaagagagctctagtatcctcagagtttggaacctaggacacattctttttatttccatctcatactttcttctccctggattttggcacatactgcctgcagtggaatcattggtggtttccagtatcttctttgaccagtcctgcagtctgaaggaaataacttctgtattccaggatttgtttgaaaagatcatagagaagattagaattagcctggcttggatcacagccctacacttttccagtcactgggcaagaggcagtgattggcctggtacaggccatgtggacagggagggagaggttattgctctgtgaagggagtaagagctgggagggggcagaggggcaatgcagacacagctgttagagcgaccgctgggatccagcagctgctgaagcctgtgtctgagattatcaagtcaagatatctaaatggcagttaaatcatgaacataaaaataattttcaaagtatgcttaattgttcagttttttaattcagcagaatttttctcctctgctaatgacaaggcagtctatattagagactgtcaaaattatttcttaagaagcatttaaacaaataatttttgtagactgctatatgcatttcattagacaaatgtatattctgctacaaattcacataatcatttttccctcactctactcaagactacttagattgtttgaaagaaggctttggctaatgggtattggaaggaatggctgattgttttaaaatatcctgttgcatacaggatgtatttttttgaagggttaagaatgaaaataggaagcaagcatgttccctctgactgaaattactttccttgaagccattagtgtgtaagtcagatgctgaacttacgatatatagatattatataatatgttacatatatacttgaaaataaaattccaaacagaataatgactgttgcatggatatataatggagtaatttactatgatgaagtctgacttgatagcacatcaacacagtaagcctcattttgaacagttctgctgtttcctttgtgaaatggtagttggaagtattgtccgcggttatgcagcatggtgtttatgaagacctttgtggactctgcttggatccatttccaggaaaaaaaatttctctgccagtgaacttttatgtttcttttgccagaaaatggagaaagatgaatgtttcaaatttttttttaagtgccaggatacttagaagcagcctggttcagtgccaagatgtagtaatcagcttcctcagatgtagtcattcattgacgctcttttctgattcaccaccagtgtcttgcaagagctttcactttatctgcctgcagccctgttttaacagtagtgttgacacaactcacctgtgtccatttgtgatttctaaatagtttttaaatcataaatatttgaacctcaaggtaacgctgtaaagtatgaatagagatgacattgtattttttcaaaaaaaaaaaaaaaacacaaaaatctaaacggaaacaagcacagatgaacttaatgtcagtgtaaattgtagattatagacttcacaaggctggtctttgttttgttcactgtatcccttgctcctagtatagtgcttgacaataaatgtttcaggatgattgatgttgaataaacttaaaaagtactcagcacctcacaactttgaagaacatggaaacacttgtattggcagaagacagaaatgtgtagccccaggagacaggagatagctcaaagcaacctgtcatgagcacatttctttgaagcctggtgttttatcttaataacccatacaaaattgaattcttctttgtattaggaatgtttgttttatcatagagattgttttaaatgttacttatcataaaatattatgcttccgcaaaatacactgtttatcttgaataccctagcgtatctttagaagtacgtacttctattgcttttgaaaaatacaaatgtccaattaattacattttattgatgtactgtctatatgctgatgatatccaaatgtatgtcttttatctttatttcatctctgtaattaccattttagttaatggcaagtgtgtttttccagttgattgagaaaaaaaattctaagtcatccttgatgtgtgttttgtttttttttaaacttatatccagtgtgttggatagtatcattgggtttgacttgagaatatatctggaatttggtcatttttaaccattcctactactgctaccaatctgccgccattgtctcttacctggattcctgcactgggtttttagctggcctgtgggttttcccttgcaccccacagcccagtctccacacagcgttggcacgatcctgtaaaaacatcagagcaggtggcacccttctcagcactctccagtggccacccatttaaacagagttcagacccacgtctccactgggcctggcagagccctctctgtatcctcctctcctactacccctccccagctctgctcttccagcctctctggcctctttcctgttcctccaacctgcccgagttgctgctgcttctggggtctgcatttgctcttcccgaaggtgtccagatggctgtttcctacacttcctttgagtcttttctcaaaacatttcaatgaggtcatccccattcattccacctacaatttcgcaccaacccccaaacataaggtcctttctcacattttttttcttttggcacttatcacatctaacatactatatgttttatgtggtgaggatattgaatttctttccttcccttcccccttccccacccctagtgcaatgctagattgcaagcttgatgagggtaggggagaaaggcacctgttacctaagagacctgccaggaaatctttgcttcatcctgatctgtctccacagttctattagaatccttcctttttactctccttgtttttcttcaagggcagggggttgatccctaacaccctcaaaagactgcctcttggctttaggatattaagccaactttttgacaaaaacacatctgagctgctttccttgggcgtcagggatggagcttttattgaagaaaagaaagacactgtctcctctctggtcacttgtttgttcctgggtttcataggtgtgtttctacgtgttagactccacaagcagtgaaactcggagatctctgagaacataagctttctcatgagcactgttttccctgtgggtaggccacccctaaggtggtggtggtggtgtttatttccctaaatggtagttacgggtcaggtgtgattcctggcacatggtaaatgctcagtaaataatttctgaatcaagactggttccctcaattttaatctgatgacttattttctccttatatggattatacttggccttcccattttaacattctgaagctgcaggagatattattaaaggccaggctacaaagagctcacgttcccttccagaatacactgtttctaacaagcaagctgaataaatttctctgaatctggatttaaacaaaattcattataagactggccttgcatttggaacatgttcttataaggaacctgtaagtcatgaatatttcactttcttttctaagttttcttttcaaatgcacatttgctttcattttcttgttaaaatggattgagaaagattaacacaaatgctggtgggaaaaaatatagaggaaataagcattcataaatattttaggcctccgtttttcaacaacccacagctgtgtgtacatagttgatctgggacagaatgccacgccttgtctctacaatgtgttgcctcagagccagtgttcacctggggaatagaacttggatgtttcggaaactgcatagcaccctagtgaaaaatgcttccaagtgcaagacagactcttatctccaaggattccagaccgtattctaccgtttccaaaaataacctgccatcatcagctttgatccctacctttaagataacattttattttctatttgttcaagtaaaacatgttcataaaaagtactttggccttttcttccatagattgtaagtgtaaaaatttgcctaggtttcggtctcagccaagatggtcaactgcatatactactgagttctgaataccatgttagctattgagaaagaataaaagctagagggatgcatgggtgctaaaaactaacaacaaaaatgctaggaaccccttgggagactgaagtgggctttagcttctgtatagtggctaagtagacgggtagctgcagcctgtggacgaggcagccataggtgtctggagagtctggaggaaactggtttttaaaactattttttctaagttatgataaagtatacataacataaacttaccatttttaagtgtactgtttggtggcactaagtgcaatcacgttaagttctgcttttgcctctcctattgccttccctgaattttatttccagcccaattgtcactcacacgtgaggatataagaagtatcttcagctatacaagaccttataaaagtttctatataaagagccacactgaaacatgctgggaggaaatacttaaatatgaagggaagcaaatacacgggcagctacaagagataggggaggtaagggggatcaagtcccctggcaaagttcattgatgtcttgaaaaagaaggctaggacataagaaaacagaaaatacatgcaagtaacccagagctaaacttctagatgttaccgttattgagtggaggagaaaccaaagacggtagggatgaagaaacatacagatggatctgctggggagacattgtgaaaatgaaaagcaagaggtgcagcttttaaaccagcagaagaaaattggatctagccaatcaaaaataggaaaggggaagtgggatggaaagaataaaacaaaaataaaatacagtaaatggaaaatatgaaaaaaagctggaaaagttcaagttttagagtaattacaacgtatattcctggattatccatcgtaaagatgtattctcagatggggcggaaaaacaagatacaaaaaataggttataagagacacacttcaaaagaagttggaaataaaaggatggaagagagagtacacaaatatgaaccaacagaaagcagtggtaacttaaatatattattaaagatgaagaggaatgctatatattgataaagggaatatgacaagaagatgtaaccataaaaaatggtaatctgcaatatagtttgaaaatatatccagcaacaattgacagaattgcagagagacatcaacagttgtagctgaaatttttaacacactgttctcagaaattagtaaatcctacagttgaaaagcaggcagaggtggagaaaacttgaaaaatacaattaataagcatgagctgttaggaatacacctaaaactgcatacttgagacaatgtgtattttttaagctcgtttggagtgattataaaaataaaccgtgtattatgccatataagaagcctcaatttcccaggaatgaaagcaataacaaattaggttcactcagtataatgcaataaaataagaaattactaataaaatgatagtccctaactcccaaaaaaccgcttgtggttacaaattaaataacatatttctaaatagctattgaattaaaaaaataaaattatgatatatttagaactgaaagacagtgaaaacatgacatttcagatttgtaggatgtagttcaagcagtacttaaaaggactttatagcttaaataaacatagtttattaaacatatagtttattaaatattaggaaacaagaaagataaaaaatgagccaaaaagttggtaaaaagaacacaaagcaaatttcaaggaaacaagatagaaaaataaaggtaagtacagaaagcaatgaaatacagaataataataataacacctgacatgatagagaaggttaaaatcaaaacttgattctttgaaagataagatagacctctgacagactcaaaaagaaagaaaagagaagctaaaaataaaatacaggacaatgctggcacctgtagtcccagctgctttgggaggccgagacaggataattgcttgaacccaggaggctgaggttgcagtgagccgagattgcgcaactactttccatcttgggtgacagagggagactctcaaaaaaaaatttattttaataaaaaatacaggacaatgacaaaaaaggaaatagctgtagaccaaagaaattttcaaatgattttattggaacaaaatgtatacttaataaatttgggggaaaagctaaataaaatgaataaattctcagaaaaaaatataaaatgtaaaaattatcctaagaaatacagaacatgatttcaccaatacatggtaaagaaatggagaaagtagtcaaaagctttcctcccagaaagcacctgagagaattttatggttgagttctactaaactttagaaagttggttcttttatgaactaatccagaaaacagtgaagagagagatgttcagcaattttctgaagttaatgaaacctcgattacagtacctgtgaatgtaacagtgtacattaaaagagtgaaggcaaaaatgcgattatctcaagcagtcactgtttaggagacaaatctggatttccaagcagaaggagatataatataggggatcaggtactttaaaagttgtaagcgttggagaagcagttttgggttgtggggtcggtggtaagatcacatgacaatccaggagacaggaagttgctactactgtcacttttattacttttttttttttttaaacctcacaaggggataactagacactggaatatagctgggcccagcaaacacatctctccagtcttgctttcttccatccgctgtagcaggaaaatggcctctacttcacctccctcttccggaggtcatgataaagcatctaaattgcatccagaaccttagctacaaaggaatctgggaaatatggttgttatctgtcagacctattcaacagagggagattgaaatggagtttgagagatgcactataaagtatgtaccacaaatgctcattacctctgctgctacttaacatagcgttttcattttatgtcctgatcagtgctatccaggaagtaaagcaagaggcatatggatctaaaggaatagataaaattgtcattacttatagaaagtatggtcatcttaacagaatttagtaaactgattactagaactaaagagtacaatgacattactgtgtataaacagtcatctcttggtatctggaggggagtggttctggaacctccctcagataccacaattcacagatgctcaaatccctgacttaaaacagcttagtatttggatataacctgtgcgtattctcctgtgtactttaaatcacatctaggtaacttatacaacttgatataatgtaaatgctatgttaagtagttgttatattgttcagggaataatgacaggaaaaagaagtctgtacatattcagtacaaatgcaattttttccgaatattttccatccacagttgatcagatccatagatgtggaacccacagatgcagaggatgaactgtacatatgatcaaactataagagtcaatttattctagtagtatccaattaaaaatgaataaaaacataagatacgacttacagcaacgaaagcaatataatatctatgaattaataagaatgtataaaaatctcttcagggtagaatttaaaatgctaataaaagaccaagattatctgagtaaatagagtttttattctcttggaggtagtcgtaaaaaggtgtcagttcttcacaaaatatttaaaattaaaccccagcatttttattgtatgtttttgggaacttgataaacttcttcttttttttttttttttttgagatggagtctcgctctgtcgcccaggctggagtgcagtggcgcgatcttggctcactgcaagctccccctcccaggttcacgccattctcctgcctcagcctcctgagtaactgggactacaggcacccgccatcacgcccagctaatttttttgtattttcagtagagacggggtttcactgtgttagccaggatggtctcgatctcctgacctcgtgatctgcctgcctcggcctcccaaagtgctgggattacaggcgtgagccaccacgcccggccgataaacttcttaaaaacataaagcagtagaggaaaattgatccacttgattttatcaccattacagattctgttcaatgaaggtatctgtagacagatgggcagatgacagaatggaaaatgatgtaggtgtatggaatgtccacaacttagattaacaggaaatctttgtctagaactgcaagaaactactgccaaaaaaaaaaaaaaaaagtgattgcaatccaaggagaaaaataagagatatgaccacacacttcacaaaacagtgaacgcaaaaggctaaccagcataggaagaaatcttcaagctcattattaccgagagaaataagaatcgaagcagtaaaatgatatccttattacactagcaagagttggctgaggatggtagatacaagtggggatgtgtgaacataggaattgtcatgcactggtggtgggagtgtagacttggcacctatactggagaacagaagttgctgaattaggcccagaaatactgatcccacatttattttcccgggtacgcatcctaggaacacttttagataattgaataagggatatgcctgaggtatagcatcattaaggcaagctgcccttgtcgtgaagtatttacattgttaggttttttaaaaacactgaggatttggtcacttttcgtgttatctacttaaggagaacagtgctttgatgtttgtttattagctttgcaacctcgacaggtatttatcctccattcctcagcggcttcgtgggttgttgtgagaatgaaatggcttgatacctgcaacaggattagaagtacttgtgagagtaaatgcctagtcagtagcagctattattgtggaattattcctagaagccgaagcactgagttgattggtatggactttccaaaggctcatcttactttgaatatttattgtgtgctactatgtgtcttgacgtttagactaagtggtcaaaaattcttgtcctggtgctagaaaactaccacagtaaatggaaaaaaggtaaatgaggtacatgctagtcattgctaacagatgaagctgcagttggagttaatggtaaatgtgcttaacttttgggttatctgatctgttttaattcttcgtttgtatcattccagaattgtcaggaggagatggtaaacctctgagggttttctttggttcttttttggttcctaattgagacaggctagagggctgtgcctttgatggctgcataacattctacatggttctttctttttattttctattttatttatcttttattcatttatttttcttctaaggcagggtcttgccctgttgcataggctgcagtgcagtggtgcggtcatagctcattgcagcctcgaactcgtgggcccaagtgggctgatcttcccacctcagcctcctgagtagctgggaccacaggtatgcacaaccatgcctggctaattttttgattgtttttttgcagagaccaggtctcactatgttgtccaggctggtctcaaactcctgagctcaagcaatcctcccaccttagcctcacaaagtgctgggattacaggcatgaaccactgtgtccaacctccgtggttctttgaacaatgatcattaagagatttgttgtttgaaccagtgtcattattgataatggataaatgcatttaatatgtagtttaatatgcatttaatttaatatgcatttaataaatgcataacttcatatgcatttaattgtagtcagctactttaggtaactgatatactctaatgtcccagcctccctccagatgaaaataatgttgttcttctcagtgttcccactgctctttttccctctattaccatagtaatcactgttcttctttatattgtggtatatgtatatttttttctcactagattttagtttcttctggccggagaccatgggtgattcacctttgaatccctaaaatgattaacattcaagaagtttttgtcaaattgaattccctccttcccccttggtatcatttgtgctctcttctgggaaatatttaaaatgtctccaaggttattgatcactacattctagaggacctcagaaatggttctcaccagccacccatgttaaagggcagacctgtggcagacagagccattataatttatgactctttctgtggtgacagatagatgtggcctttggtaggctccctgattcaaaatggtttatcctgagctgatgtcatctttgggagtacctgtaatggatctgatcaccggatcccttcaggcaccacacaaattccagcaagttttgcccctagctaggagcatatatttattctacattgctaatagacagaaaatattttcccaaaggaattataggcaatttgctttagtatctttatttactatgcaaataaacatttatttttagtttaagttctctaatttattgccgaatatttagtgtggcatatgttttttttttttttctagtaactcattaccatgagtggttcttgggccttaattttctcatctgaaaaattaacgagtctgtatttttttatatttactcatttaaaatttatatctcgcttagttttaaatgttttaaaaagtgtttaaagttagtgaaaagagtacagagaatacaaaaacaaatactatatccagtaagttagaagcgagaaaaacaaggaaaaacagaagtcggaattcaaacgagaaccagaagtaaggcagatagacaaatgctgagagcctggttcatctgccaggaccgtgcatgatttgagtgatctgctctctagcaactaccagggaaaaggaatcccagtcagtcacctggttcccaaggttcatgagataatctctgagaagtacaactaatcatggtgctgggaggagaaggatatttctcttgagaagtctggaggagagcactgtgattgaatgagcccgaggctctgcacttcacggcccctcaggcctggcagtatttggagatcctctgctgctgaggccagggtgtctgtgcccacggttcatcattggtgtctgctttgcattcttcaaggcaattttcacttccaacgtgatctacagaagtgctcacaagagcagaccctcaggaagtggcagccatgactatagaattattcctggaaatcaaagcactgggttaattggtatggattttttttaaggctcatcttactttgtttgaatatttattgagtgctactaatgtgcttggcttttgttaactttcggaggaaaaatttgacctcaggcttgttagagtctgtcctttgtgacacgcagttggtacgttgtttattttatggttaatgtgtccacttggtgcagcttgtgtttgataaaccaccatctccttttcctctgtctcccagaagttcagagtgtttttctctcactttggccttaggaccattattttctcttaccagtctgttttctttataattctaaatcacacacaccagctccatcatttgagagaggtggggacagaaacaactggctcctacttctctgtgtcaccaccagtgtccagttggtttgggccaagccttggactgcatgtttcctggctttttaagtatcccttgactcaacctttttggcatcaggactggtttcatggaagatagtttttccacagcccagtgggcagggaggtgatgatttggggatgaaactgttcagatcatcaggcattagttagattctcataaggagtgtgcaccctagatccctcacgtgcacagttcacagtagggtttatgcccctatgaaaatcaaacgccgcctctgacctgacgggaggagttgctcaggcagtaatgcttgcttgcccactgctcacctcctgctgtgcagctggttcctaacaggctatggacgggtacccgtccacagcccggagttggggatccctgccttaactaagggatccctttcccccaactcttctctgcatcttgctggatgaggaggtttcccatttactccattactctttcaagaaagtctccaattctgtcttatctggaaatacttcttgttttctaatgataggttaattcataacaacatgatcattaacttatgtcacagtcgcagatggcagtggcccggccatatcctgcagtctcacgtaacgaggcctgtgagagtcggtgtaatttactgcactgatgggtccctaaaggcatttcaggctttgctccacaaagtactctcttttagcacaaattaatgttctttgttttgttcagtgacttttgtcaatatataaatcttagaatttattataatcacagtttgcttgcttacttttcatgcatgcttctttaatccagggtgatttatgtgtttatgcatgaatttttctgtcagaatatgaactgagatatttgcacttaaagtacacacgtttgttttacattttctcacagagctaatactttgttttcccaaaatacatttacttaatgaaattcggatcttcatgttgagatgttcatttttaaaatttgactttagttatgttaaccaagtctgcgttacttaatttaatttggagtcgacttactgaagttgataatttacttaaatgtaatagctgaactgcgtaaattttaaaaacttatcctagctatttgatattaccaatctataaaatcttgattttgatgttgttgttcttactgtagattatctttgttattaagagagcagctttttaatttttaatttttttttgagatggggatcttacattgtcacgcacgtgggggtgcagtggcacaatcacagttcactgtaacctcaaactcctggattcaagtgatcctccagcctcagcctcccaagtagccggaactacaggcccgtaccaccatgcccagctaatttaaaaattttttttgtacagacagggtcttgctgtgttgcccaagctggtcttaaactcctgagctcaagtgatcttcctgccttagcctcccaaagtgtgagattacaggtgtgagccacgacatctggcctgaaagcagccttttgttttacagtttgttctaagggaattcaaagctccacatcttttaacgattattactatttgatctaaaacctttttgaagtaatctgctttgaatcatgtgaggagctcaatgaatataacattcttggtaatcagagaatgggattaaatttttaacttggatggagcagttccagcatgagttatgacgaagtgtctagtgacctgttttctaaatgttgaattaaatctgctatctgtattttaaaagctaatcggtatatttctacctagcccttaaaaagccatcactcatactctctttccatcccatcccatcccttctcttacctaagttacttacttgctatctgctgttaggaaaaattttaaaatccacttattgaacatgtacgtacacaagattacttggctaactatcaatgccaaacagtcagtgaaaggacaccctttaaaataagacttttacatcagcaagaaatgactagtatattttattcaactcaacaaacatccactgggcacttatgttcaaagtactgtgggtgatagaactaataagttagtagtttctacctggaagtaactcacattctttttaaaatttttttggtctgtttctttgtcagacctttagtttgtttaatggaatgtcacaaatttcggtcaagtaaggtgtttttgattgatggcagttctaggcaaaaacgcctcagtgaagatggagagcccatttgggatcaggatcatccagcccctcagagcaagagtatggagatcatattcacagtgggtaccaagacctaggcttggcgtaggcatcacttctgactggggaatttcctataaactgcgcagaccaatgaatgaccacagaggagatagctggcgtgtgcgagaaagagcaaagattaagtgagcccaacataagagtgcctagcaaatcgtctcactgtgtgtgagcccaatgcatggtggcttctattattattattttattctgacgagctttactcagtgaagataggcaactattcagtcatctatttgtcaagtgcctgtaatgtaacaggcgtgatactaggtatagaggatttaacggtgagctaggcaaatccagtcattgccttcacaggactttcacttagcaggggcttcagacaagtgcgtgggctaaacagttgagtaaacgtaaacatggtgaaaaatagagggtgctattgaaatgtattcacctgaagaagggaggaagagattcctggaagaattccattggaagacatgtttcagttgaaaagtaagtaggaattgattagaataggaggtggagagagaggtggacagtgttgcaggcagacggagcatctggggtgaccacccaaaagtgagggacagtgccaggccccaggaactcctttatgcagcccaggcacagccaagtggggcttggtgtgggccctgaccctcagtttgctatgaaaatgtctgggctttatcccagagcagtggggtgctatagttgagttttaaatggggtgcttatctgatgaaatacttaggaagattaccctggtctcagagtggagactgtgctgggagggtggaggaagagtggcagaataaaggcattggtgggacgatggctggagctgagcaagggactgacagtatggcctgcacaggcagaagaacacatgtgattacgcagaggcggggccggtggggccagagagagcctcagggggctgagcagagcacccttctctgctgggccagccttgggatgatttatcagcagaaaactggatggatctgtttgttcaagggcccagggaagacaggctttggggagcccccatcacaggctgaggacaacagatgcagctgccccctgagaaacaacagcctccacgtgtgcacctcgggaagaagtgagtcacagtcttctcagtcacacccagcacctgcttaatggccacttcttccagagccagcctttgaatatgaaaaaacaataatcaaatgatcttcttcccaggagttgagtcggtactcctgattagctcagggccaacactaaaactagaaagctggaggctttctgggagccaggctgcgtggtggctgatgtggccacataacattgtgatttttgacccttccttttctaagtcatgctgagaacccttgaagccccctgctgttcttctgttttccattttctccttccagtactcattaaaaaataaataaataaactgaatgtgtaattaagcactatgttttgtgtcctttttatgacaggttcatcaattctacatgcatttactgaatgcttactaaaggcagggctgtattttacatatcattctttgtgaagctactgttttcacttcggttctgcagataggttgggtgttgaagaatttgtagctgaggatagactttgcctctgcagctatccttcctgatcagactagacatatacctgattttttttttctttttttttttgagatggagcctcactctgtcacctgggctagagtgcagtggcacaatctcggctcactgcaacctccacctcctagattcaagcaattctcctgtctcagcctcccgagcagctgggattgcaggcgcctgccaccatgcccagctaattttttgtatttttagtagagacagggtttcaccatgttggccaggctggtttcgaactcctgacctcatgattcgcccgcctcagcttcccaaagtgctgggattacaggcatgagccaccgtgcccggctcacatacctcatttgaccctgtggtgtgaagttgctattcctactgttgttaactgatggcagaacgtaggtttaaggtaaccaacggggctagcatgcttgttgctgaagtatatgaatgcgggaaaaactcctggcctccccactatgcccttggctctggtcagtgctgggtgcagcgtgcctgccatttgcaaagcaaaacctgtaatcccagtccgcatcattcccctccacgcatacattttatgcagctaaagtagtgtataaagtagctgatggaatactgtactgcctggcttcttgaaatttagaaggaaaacatttcatttaaagttacgaaacaaaccaactactcaaaggcagaaataaggagacagatgatgaaaggtgacagaaacttgactgatatgaccatgttagaattacagaattaagaagagaagtaccaattttacaaattacacgaaaggcattttctctgagttgtagaaagtgagtgtgagctgttgtgtgggagcctcttggtagctgtgaagtacgggtagtcatgtctggagttaccctttctgccccacttccagttgctggaatcatcacagcctcccattcctgtgcagcctaaagaatgcctcctttgcctcttacaagacagattcttacgttgaagttgacatctgccacctgactgccataaccaaataccctagactgggtggtttaaggctgggaaatcagagttcaaagtgccaccagctgagtttctggtgagggctcccttcttggcttttgtaggtggctgccttctttctgtgtcctcacatgcctttgcttggtgcatgcatgtgggaaaagggagacagcacgcatgaattctctggtgtctcttcttgtaagggcaccaattccatcatgagggcccctcccttaggacttcttctaacccttattataatgcctcccaaaggtcctatctccaaaggccatcacatcaggggttagggcatcaaacgaatgaattttggggggacacaaacatcagtccctaagaacatctaatttgatgtttttatttaagctaaaagaatgcattttaacattttcgggttggggtgaggggggacacccacattggctgtagatagtgctttttgctgggttttgatttttcaggatgagggaaaatcgatctagagagaaacaatgaaatttcattaagaacttcaaagggactgtcttcataaaggcaatagatgtgtttagagaaggtttgggggatcaacttataaagagcattcaaactcttcattttttttgttctcccagatttatgggaatgtagtagaaacaggcttcccagtctatcatgtgtcattgaaacgcaaaacacaatagcgtttgtcttgttacaaaccaggaggctgtaaatctattatttattttttattaaaggtgcaagttccagagtgaggctcatgaatagcccagagaaataggagatgaagcctttcatctctgttctgttcttccccatgtgagccaggtcaccagtgattgaatgggctttctgctcttgtgaaatatgtttgtttacctggactatgttcaaaaggtaaagaaacaagaaaagggaaagatgaggaaaatcacaaacctgactttacatttcagatccagtttcaaattgtaattagaaaaagcaacattatttccagctgtcatcagaattttctactagaccaggtgtgctttggatctcttaagggatattataaataatgtagaataataatgctgtgccattcagacttctcttttatgctcatcacccccaaataggctccttggcgtcaccgttgtttacggagtgctgacagtggccacacccaggtgaaagcttctggagttacactgtgtacttctgtgtgactctgagctaggtggggccatctgcaagtgagataagctgtgtgttacctggttagagaaagcctgtgacttcctcaggggagtcgcaggtacacaaaacattgagcaaagaagtccccgtttgcagtggtccagttagagatgtcttgctccttgctatgtttgccttttgaggaactgatctagttcatggctatccagaaaataattggattttttggttgtactttagtaaatctgccagtatctttaatttcctagaaaaatgtaagtcataatatattctgtcatttttctccagtgtaggcaacgttatcgatacccatgtgacttatgcatggtgtgtatgtggctgcattttgcctgtgttgagccacgtgcacaaactaagaagtgtttcttatttgctagaaacaggagcttcagcattttgttcctgatgcttccttgattcaggcagaaggtatttacttgtaaattatatacagtgcatagtctctgcaaagcagaagttggttactatttgccgggactgcttaaacctgccctttagagtagcagtttagtttcctcatagctggtcgggcacctgaagaaatagtagacttttgatgtgtatccttttgcacttcaccacggtggatggacttccatcatttttcatcgatgcccttgtggccaccccctgacatgactccttatgcccaatccaccttgcaaagagaggacagcacacacatcctcctggagcctggccatactggaagatttcgcctgcctctgggccccattctaaatgaaatccacacacactcctccatctggaatcgcagacctactgcaagacccccatagcccacctttttattccctttccttacactactctacaaatcatcacatggtcccagtaacaatgagaatagctaatagcagcgctctgagattggttctgttatttacaccattttacagacaaggaaacagagacttgaaggataggtatccaggccaaggttttacggcctgagcgtcatagcatcagagtggcccatgatgtctgaccatgcaggtcttcactgagacgtgctccctttactgttgcccctggacttcatgggctttcatgccctacaggatggctcttttcatgctcttccctctttcttcattgtttgtgcctccacctcaagggtaaccttctgtgcagtaggtccatgatggaacctccctccaggtaatcctcatggaactcacttttgcttctgctctttattgaacctgttttgtgtcagatactgtgctaggagctgtcaatgtctgttaggttaaattacaaggacataaactgagaactgagcccttgaagtgctgtgaggaaggcattttctgtgttagtaacgagtgcactggcttgcattcagcttttgtatggtcatattgtcccccaaccatgttagaagcttcctgagggcagaaactctaacttcctcatctcctgcattgcctggcagctcctgtcatgtccgtacgccttagaggtgtgcggtgactgcattgctgatgtggtttaaaggaacctggagctcttagagaaatgattagaaggagcaagagctgagagactagtgaaatttattctttccactcaacttacagtgagagaggtggcaatgtttctttcttttcctccttcccttgtttttttgtattcatcttgtatattttctctctctaatttgcattattttttatcaggggaacccacccccaatatttcaacataggttctttctattttccattagcatacaaagagaggaattttacagttgggccgccgggggtgacatcacatatcggtaggaccatgatgcccacctgagccgcaaaaccagcaagttttattaaggatttcattaaggattttattaaggattaaggggagggggtgcaagaacagggagtaggtcacaaagatcacatgcttcaaagggcaaaaaggagaactaagatcacgtgcttctgcggaaacaggacaaggcaaaacagaactactgataagggtctatgttcagctgtgcacgtattgtcttaacaaacatcttaacagaaaacaggattcgagagcagaaaaccagtctgacctcaaatttactagtacagggtttcccaatcctggtaagcctgagagtactgcaggagaccagggtgtatttcagtccttatctcaaccgcataagacagacactcccacagcagccgtttatagaccaccccccaggaatgcaattcttatcttagggtcttaatattccttgctaggaaaagaatttagcaacacctctcctgcttgcacatccgtttataggctctctgcaggaagacaaatacggctctttttgcctcaccccacaggcagtcagaccttatggttgtcttcccttgttccctaaaatcgctgttattctgttctttttcaaggtgcactgatttcatattgttcaaacacacatgttttacaatcattttatacagttaacccaatcaaagtggacctgaggtgacatacatcctcagtttatgaaaataacaggattaagagattaaagtaagacaggtgtaagaaattataagagtattattagggaagtgataaatgtccttgaaatcttcacaatttatgttcctctgccgcggctccagctggtccctccatttggtgtccctgacttcctgcaacaacttttcctatataaagggggcttatgaaagtactatcttctactgaaactattccaataaattgaggaggagggattcctccccaagtcattctataaggcagcatcatcctgatagcaaaacctggcagagatgcagaaaaaaatgactttagccaatatccttgatgaacgttgatggaaatatctgcaacaaaatacctgcaaaccaagtccagcagcacaaaaggactccaccatgatcaggtaggcgttatccctgggatgcaaggttggttcaagatatgcaaatcagtaaatgtgattcattacataaacagaactaaagacaaaaatcacatgattatctcaataggtgcagaaaaggcttttgataaaattcagtatcccttcaagttaaaaactctcaataaactacgtgttgaaggaaaacctcaaaataataagagccatctatgacaaacccatagccaacatcatattgaatgggcaaaagctggaagcattccctttgaaaactggctgaagacaaggatgccctctctcaccaatcctattcaagatagtgttggaagtcttggccagtcctggttgtggaaacaagggaacacttacaccctgtcagttggaatgtaaattaaaccatttggaaagcagtgttgcaattccccaaagaggtaaaaacaggcaaagaaagggcatccaaagagagaggaagtcaaagtatcctttgtttgcaggtgacatgattctacataaaaaaactgggtaaagtctgccacacccagaggtgccttgggtgagtcatcatcttggcccaaagtgttcttcagctgataaacaatttcagcaaagtttcaggatacaaaatcggtgtatgaaaatcattagcattcctatacaccaacaacatccaagctgagagccaagtagggaatgcaatcccattctcaatagccacaaacataatgtaatacctagaagtacagctaaccagggagccaagagatctctacaaggagaattacaaaacactgttcaaagaaatcagagatgacacaaacaaatagaaaaatatttcatagtcatggttaggaagaatcagtatcattaaaatggccataatacccaaagcagtatacagattcaatgctattcctatcaaactacccataacattcttcacaaaactggaaataactattttaaaattcacatggaaccaaaagagagcctgaatagccaaggcaatcctaaacaaaaagagcaaagctggaggcatcatgttacctgacttcaaattatactgcagggctacagtaaccagaacagtatggtacttgtacaaagacagacacatagaacaatggaacagaatagagtacccacagataaggccatcacacctagaaccatctgatctttgacaaagctgacaaaaacaagaaatggggaaaggattccctattcaataaatggtgctgggataactgactaggcatatgcaggggatttttttacaccatgtaaaaaaatcaactcaagatggattaaagacttaaatgtaaaacccaaaactataaaaactctggaagatgggctgggcgtggtggctcacgcctgtaatcccagcattttgggagactgaggcaggcggagcatgaggtcaagagattgagacgatcctggctaacaccgtgaaaccccatttccactaaaaatacaaaaaataggctggatgtggtggtatgcgcctgtagtcccagctactcgggaggctgaggcaggagaatcgcttgaactgaggaggcagaagttgcagatgagccgagattgcaccaccacattccagcctaggttatagggcaagactccatctcaaaaaaaaaaaaaaaaaaaaaaaaaaccaaaacaaaaccctggaagacaatctatgcattaccattctggacataagaactggcgttaattgtatgatgaagatgctgaaaacaattgcaccaaaagcaaaagttgacaaatgggatctaattaaacttaatagcttttgcagagcaaaataaactatcaacagagtatgcagacaatctgtagaataggagaaaatattggctaactatgtatctgacaaaggtatatccagtgtctataaggaacttaaatttacaaaaaaaacctattaatcgaatatgataaatcagtgctatgaactaaacagatgctaatcactattattaattagtgggcaaaggacatgaacagaaacttttcaaaagaagacatatgcagccaacaagcatatgataaaagctcaatatcactgatcactagggaaatgcaaatcaaaactacaatgagatgccatctcacattagtcagaatggttatcattaaaagtcaaaaaataacagatgtgggccaggttgtggggaaaggggagcacttacacaccgttgtggggagggtaaattagttaaaccattgtggaaggcagtgtggtgattcctcaaagagctaaaaacagaactaccattcaacccaggaatcccattaatgggtatatacccaaaggaatgtaaatcgttctacgacaaagacacatatacatggatattcattgcagcagtattcacaatagcaaagacatggagtcaacctaaatgctcatcaatgttagactggataaagaaaatgtggtacatatacacctcagaatactatgcggccatgaaatagaatgagattgtgtcctttgcagggacatgggtgaagctggaggccatcatccttagcaaactaacacaggaacagaaaaccaaatatcacatattctcgtcagtgggagctaaatgatgagaacacatggccacatagaggggaacagacaccggggcctacttgagggtggaagcctccctcaggtaggcctgtctcaggtagatctgtctcaggtaggtctccctcaggtaggcctgtctcaggtaggtctccctcaggtaggcctgtctcaggtaggtctccctcaggtaggcctgtctcaggtaggtctccctcaggtaggcctgtctcaggtaggtctccctcaggtaggcctgtctcaggtaggtctgtctcaggtaggtctccctcaggtaggtctgtctcaggtaggtctccctcaggtaggtctgcctcaggtaggtctccctcaggtaggtctgtctcaggtaggtctccctcaggtaggtctgtctcaggtaggtctgtctcaggtaggtctccctcaggtaggtctgtctcaggtaggtctgtctcaggtaggtctccctcaggtaggtctccctcaggtaggtctgtctcaggtaggtctgtctcaggtaggtctccctcaggtaggtctgtctcaggtaggtctccctcaggtaggcctccactctcaagtaggccccagtgtctgctgtggagggtggagggtgggaggagggaaatgataagaaaattaactattgggtactaggctttgtacctgggtgacaaagtaatctatgtaatgaaccctcgtgacatgagcttacataacaaacctgcacatgtagccctgaacctaaactaaagtaaaaaaaaaaaaaaaaaaaaaaaaaaggtaccatcagggctagtctgagacttcagggacttaattcctcattgtaattttgcaaataaaggaaatagagttccctttcacgttctccaggctcttcagcctttagtcttccccagcaacccctacctgctgttttccaactcagagcgtggcaacaactttatcattaagacctcagagatgctgagtggaagagaagtgtgtgtaggaaaaggggggcagataaccaagcaatcgtataggtaatgatcatgcatctagaactccgaagtgtgctgcagagtgcattcccaagtccttccttctgtgacccaggtctagtcctaaatgcagagggcaggggtagggatgggagtaaaagcatttggacaaggaaactgatgttggagaccggaggtatcggtgtcaacactctgcaggcctccagctggttcctgcgtgtaggccatgcagcagctcgaccttgtttacagctctcgggctaatgaggattatcatttatgcctgagagtatgtaaatttggcagttcctgctctaaaataacattctccatctttccgggagtaaactgctttcttagtaaacaaattttcagtgcattatgttaccatttagaaactttcctcttccggtgccaaattgctcttaaaggtgagtgattcataaaggatattttatttaccttgaactcagcttctgtttggaacagtattagaacacaaggagagtcagtaaaccatcgctggaaatatgtgaggagctaagacattggaatccacatctgtatttagatcttgagaggttgcatctgtctagttcatagcactgatttctttatcattcactgagtaactagtaagtacaaaaccctctacttggggagttccttgagatacagaaatgaataacatatcagtctctggcatctgtgcttctacactttggagagggaaataaaacaagtagtaagaggcaggagtcccaggtgccccctgagaggcatggcatgccacagaaggcattggcaggaagactgcgtccacctgcttgcagggtcctgtgaatgccaccgagagggcggcatctgcaacagtagaatttatttcactggagaaagaaggtggcaggcatttcaagtggagggaacaataagagcagaagaaagcatgggactttgtggagcacagagaggccttgtttgcttggagtgaaggtcccgtatcagcagaccaggaaggaataaggctggaaccccagtttggggtcagactccaccccaagtccacaccattctgggagggaacggaatgccaatctaaggtgccagggagaagtgtttgaagtttgtacagcaggggaaagacatcgatttgaatactttttcccttagtatgtttttgcaaacctattttggggtattgtaaaaagattctgtgcttatatgaatttgggaataaacaggtgcttgctgtaaggcttcttagggcccttaatatgctttgtgactgtaggaggggatatgttgtgtcatctccaaacgtatttgaccatgagatctatttgaatacaaacctaatgcacctctttggatttccttggcttcctcctccttgcctggcgttccctgtctagtttcacgtgaaaccccatcccttcaagccccacatgacccttcattctggaccttattctgattgagctttcacttcgtttctggacttggataaaatgctgcaaacagggttgctaagcggccaccaagggctgcctggccccacctgaagtcccctgtggggccgctccttgagagttgaacctttatcaatgggaaccaggaaggatcctggccaggtgctttcccattctttgttgttccacggactgctccaaggtatgctggcttctgagagaactttccagagaagtcgcacgtgcttgggcgtgtccgctgagtgagctggtgtgtttttgggtctgtgcccttgctgaaattggggtgacccatgacttcacgttattttttttttttgagatggagtctcgctgtcccccaggctggagtgcagtggcgcgatctgggctcacttcaagctccgcctcccgggttcacgccgttctgctgcctcagcctcccgagtagctgggactacaggtgcctgccatcacacctggctaatttttttgtatttttagcggagacggagtttcaccgtgttagccaggatggtcccgatctcctgacctcgtaatctgccctcctcggcctcccaaagtgctgggattacagacgtgagccaccgcgcccagccaacttcacgttttgagtgatccactgcctcacatttttccttgcttcctgtgcctgtttccctacatcctgctgccctagttttgtacttccgaaataaaacatcagcatgtaatccttgcctcagcctctgctttccagaggacctgagcaaagatagactctgactgagtgctagagacgggtgtttcacagactcactttggaaaatggctacgtaggctgaactcagacattgagctttaagagtggctggttttgtaatagaccagacaagaaataaaataaggagaggaaacaggtagttgatgaagtgaatcagaacttgtaataaagctagagtaatggatttaagagtaggtctcatagagataattgatgaaagaatgagcgtataggctgcataagttgaggggataggtagaaaaaagagatgacaacattaagcatggaaagagagagaaggaggcgctcttgataaaggactgatggtagctggaggagtggagtgccagggcacaaagctgcaagagccctgaagaggaagaggaagagggtcatgaagaaggaaattgatcagggtcctggattcctgaggtacatggtcagtggtaacagagaacagagggggcatacagcaggtgtgctgaggtggctctgagagacgggagtttggtaggggagggaagaagggtggttgctagacagtacatcaggattgagcacagcataagagatgaaacgggggagaaatctaaagacaggtgtgccacttttgcctctaaacatgtggtataatttttgtcagcgaggaaataaatctgtttctcttttccattttccaagaagggagggaaagagattagaagtaagactgacatctcagggcctctaccatttctttgttgctaaaggagacacagtatgtggctctttgtttcagcaaaacactaatcagctttcggatatgcaaatatgggctgcagagctgattgagtggaagagagctacattgctgtgctaagtaaaggaagaggaattgcctttgatggtggggctggcccaggagagaagcagggaggtgtgtagagtcgctgggggagagagcgctgagggcttcaccattgcctaactctcagtgaagtgtgccacacccagaggtgccttgggtgagtgtcttggtggaaaggaagagaggtaggatttaagtcatacaaaatgggctaagttactgggtcaacatagacctccgaaagagcccgccctaggccaggagtcatgagtgggaggaagtgcacccagtggaggtgaccttgagaatgtgtttcttaggaattcacagcaaattgaggagggctcgagaccccccatgatatatagaaatagaggacagggccgggcgcggtggctcacgcctgtaatcccagcactttgggaggccgaggtgggtggatcacgaggtcaggagatcgagaccatcctggctaacaccgtgaaaccctgtctctacaaaaaatacaaaaaaaaaaaaaattagctgggcattgtggcgggcgcctgtagtcctagctactcgggaggctgaggcaggagaatggcatgaacccgggaggtggaggttgcagtgagctgagatcgtgccactgcactccagcctgggcgactgagcaagactccgtctcaaaaaaaaaaaaaaaaaagaaatagaggacagaagcaattttgttacagtgtctaaggacagagtagccttaactgtcatctgggtatcatgtgggatgtctttatgttttgggggcaaggggaaagcactcactgaagacagaagctgccacttgagcagggaggtgacatgtgctggagctgttgtgagagccagcgtattaagggttctgtaagagatttttttggtaagcgttgagagtgcatacagagtgagcaggcattgtggtgaagcagacagcatagtgctaacttgaggtggaggaggaggaggaaggaccctgggcacagtgcagacatctgggctttgggctgaggccctgtcagagagtgattcttgggcatgtgtgaaaacctttgttgaaagggtccagaaacaatggctaagtcctaacagaactctgctgtggacctagggaaaaggaaagaactaagaatttagcggtcaatttgaggccaaagacagaggagaaattgagggtcagaggggatttagagtttgagattttaaacatttgctgtttgtattagtcaagattctccagagaaacagaacgtgtgtgtgtgtgtgtgtgtgtgtgtgtctaaagagatttattagaaggtgttggcttacgtgattatggaggctgagaaggcccatgatctatcagctgcaaagtggagacccaggcaagctggtggtgtagttcaggagtgttagagccagagagccaagggtacaggttccagtatgagtctaaaggcctaagaaccaggagtgccaagtacaggagaagattgatgtccccgactgagctgtcaagaagagagaaggcagtgtgaatccaactttcctccgctttttcagcccccaatggactggacgatccctacctacatcggggatggccgtctgttttactcagttcaccaattcagatgctgatcttctccggaaataccttcacagacacacccaggaatgatgtttaattaagtatctgggcaccccgtggcccactcaagttgacaaaagtacactgccccttggcctttcctgagtgttatctagctttccatgggtagacatcagctctccacatctaaattgtaagctgctccagggcaggggccagatcttctcctgtgtgttctcagtagctgacacaattgccttccatgtactaaatgttcagtaaacatgtgttggatggttcattgatccaatagacttatgtctatgccaatacaggcttgctcttgaaaagctgcgggtaaatcaattctttgtaaattgaatcttatttcaaatgtagtagggatgttcagcatttcaaggaatcctaggtcaatctttggtggatctacgagccctgtattctgccattctcgttttacaggtaagggagctgagttacagagaaattaagtgacttattataatctgatttgtcagtcaaatataaggtttcttcaagcaaaacatacctgttacttaggtcaagagggatttggtgaaaagcctagctatgaaatttataacatcagattaataacgttatattttcagaagcatttatttttagtctgcagatatttattaagtttgtttacaacagtcttttagttgtatactaatgagtaaaggctatgctaaattgtgttgcagtttatgtcagattagaaacaaaaaacaacagacacaaagtttctggttcagaaaattcacctctgaaagcccccagctcgaagtgtttagtttttcttctgtgaggtgtgagaggatgttgaatgtgctggacaggtgccaggtcctgcgatcctgcagggtgcgttcctagattcattgttgaggtgatgaaagtctcttcagtcagtggcttaatgttaagtgtgagaaagatgttggaaaagatttagggagaccttttgggcacctcactgatggaattattttaaattgagcaggttttatcaacatctgtattgggttgatttagtttctccttgctatcagttctagaataaaatagtttattatatgtgagaaaattgataaaagtgtaaagctactttgcatcactactttggatgatccaaataaaggaaataaaagaatcaaagcattggatttactctgctttcctttctcttcatagtcatttttatgtgttttggcttatcaaaaatgagatcaaagttgttatatactacaaaagaagctgcttttttatttaggattttagtatcttgacatggagcagtgaatcagatgtggggacaggagataatttgtattcatattagatcaatattagctaacagctgttttacggacatcaagtcaattctgcaactcagcagggagaaattattaccccctttttagagatttggaaactgacttcacagttaatgtgggccttttgacgtcagtactgatctcacagttggcgtggagcttttgacgttggtactgatctcacagttggtgcggactctttgatgtcagtactgatctcacaggtggtgttggccttttgacgtcagtactggtctcacagttggcgtgggcctgttgacgtcagtactgatctcccagttgtcatgggccttttgacatcagtacttatttcacaggtggtgtgggtcttttgatgtcagtgcacagactcttcccgtgcaccagcaccacctccatggcgcctccccatgtcttttaggttttgcgtatattactattggctgctgtgagcaccatttttggaagtacattttcatattgcatgaagaaatacctgagactgggtaatttataaagaaaagaagtttaatggactcatagttccacatggctggggaggcctcacaatcatggtggaaggcaaaggaggagtacagacacgtcttaaatggaggcaggcaagagagcatgtgcagaggaactgccctttataaaaccatcagatctttgaggactcactgtcatgagaacagcatgggaaaaaaccacccccatgattcgattgcctcccactgggtccctcatgacacatggggattatgggagctgcaattcaagatgagatttgggtggggacacagacaaaccatatcagaagacagttataatatttgcataatacccagactgtgaggaataagccaagtaataagcaataacagatggaatattgaggttatgcagagtctgtgctgtgcatgtcacagcctgcacttgacctgagtcatgtgcttcctgagctctttacagggtgctaggccaggatatacgtgagagttacagtgattggaaaattagttttcctattagtgtaaatacgtatgtgttaggggatagatgatacactattacagacttataaaatggaaaactaaaattggaatgtaaagcttatagcaggtagcctcaggctgtgctcccaaacctttgggttcagtttctttatgtttcttcagttttctgttacggatactggagcagaagttgaattttagtggatttgatgtaaagaaatgggtatatttcaactttcacctcctttcctgttcctttttttttttttttttttttgctttgaagtgtgaatgaataatactatagacaaaatacaatagcaaagacaaattatggataaattggaaaatcaaactctgcagaacaaagattttttagttttacatcatgtaacaaatttaatgacaaactataccaacaagtgaattgacgatttaagatatttcatttagcttccaaaatgtgaatgctaataagtttgaaatcactaaatcacagtaattccttgcattgggcaacagaaatctattaattaaaatgaaaagtctaaagatattttggggaagattgcaaatttcaaataactgtatgtggtatcctccagttccttttaatagtctcatccttagctgcgcatttacttcacaagggaaaccttaaaaatactgataacagagcctcactgctggacctttagatttaatgggtctgcagtgagggctgagtatagcacttttttttttttttttttttttaaggcctggtcttgctctgtcccccaggctggagtgcagtggcatgatcgtagattactgtggccttgacctcccaggctcaagcgatcctcctgcctcagcttcccaagtagctgagactactggcatgtgccaccacacgtggctaatttttgtattttttgcagacatggagttttgccatgttgcccaggctggtagagcattttaaaaaactccccaggagatcctaatgtgcaaagttaagaacaacggtttatatgataatcattctttaatcatattatttgtttaaaggtagattcctgtattttaacattttaactttaaggttgtgatactctgatgaaggcagctcctatcaacctgtaggcagttcaaggtgttaacctttatctttaatgtttttatgtgtcagatggcagttagtataaggattacctttttccttttgcagtgtcataatactgagtgccaggacctaagtttttgaaacctcccagtagcccctttttaaactgctctgagcctgcagggcacagcatgacctagctgttaatttagtactttcatctgattgacctgggaaggatcactggccgcctaggggagaccttcccattattaattcctgcctggatgtcctttatgtgtctgcacagaggtttcggctttggccacgttgtgaaagtcataaaattaaagaaatattttgcactggctgttcacattgacattcagaaaaacaaattgcagtaatcactggggcctcttcctttgaaagaacatgcgaccagtgcctttttagtttatatcttggtagatttgcagtgggtctgctgtacgttgatgggtgggaagtgttaatgatcactgtgggcccatggccgctggaagctatttgtattctttgcactcgtgtggggcatgtgtgtatatgtgcagaggtgttcatatattgcttttgtttgcattttaaacatgaagctcatttttaaagtacttgcaaaatttatccaatgggaggcaaacctttaaattagtgattctcaaactttgagtgcataaggatcagatacagggaacctggggtggtgtctgaagtttgagaggactggggtcaataaatttccacaaaaggtgacttctcttagatgcccggatacagatgacaaacaaggctacagatagttctatacagaaacaaatgaatatatttttaccatttgtggaaattacagttttgaaactgggaagccctttgtatcactatcagctctatttttggaagtaatggaggaagtatttcaacctgattactgcctgtggagtgaggaatttcttagtgtttgactgaccgcctgctgatactttatttctttagagctcctcaagtcattataagaatcacccaacagtgtgaaatcaaaatgatttcttactataaaatgtcagctatctatcgtaaaagattatgtgccatttaaaaatataattgccgtttctcccctctcccccaccttacattcagatgttccagaataacagaatccctgcaaaatgagaaggaatccctgcaaaatgcaaggatctagcctgtgcaaatttcagaaaccgccttctactttaagtcttttaatagtccagataattatcactctgctcactgcccttttctttctctctacctcctcgtcattcttgcgacattttaatgatgctgtttgtgtattgctgctgatgaattctgcccagtgaaggttatttatttatttttccctgagctggattttaccctctgtttacttatgttggtgttctgtttcctttcctaactgctaccagacattcgtttccatgcctttgtataatgcacagcaggctgatgaagcgtggggactcgcgctgtgggaatcctgcttgggtaaatgtcaccgctttatataaagaactttgctctatcgtagctccagaatctgctcagattgccacaccttaacatatgatctgattattaggaagtatatgtttgttgtgttttgaaacactgatgggtttttaatgcactgctgattaatatgtgaaagtgaaaaccagccagtgaataacctggagtccttgtcctcctgccctctgcaggcttgcagggcattgggcagctgggacttgtacctaggacaagattacccatctgtggaaacgcattgctgacacctggacaaaacgagtgttgcaagtggaaatcagtggagatgcagaagagaattttgcctctgtcctgctaatggggaacatatttaacttggtgcagtatctgcagtaagctagtgtgttaggtactatttgaaggagtcttactcatcatcaagttaatttcttgactttaagaacgtatttatgcagcagcccttttctcagcacctctggacttttgaaaagtggccttttgtcttatttctacatagaagcactgcccctgtgcttccctttctggtgtagggcgcatggagcactggggacaaggtggggctgtttctcaaatctcctgcccccaggtctggggatagtatgtgatgcacatgagcttcaccatgcatcagctgccccgttctccaaacctagctttactcaaagaccttggtggtttggaagtgctcagctcatctttgtatacttctacttgttttggaacatcattcctttgaagaaaactttgaagacagcttctcaagatgtttgtctttcctattgccgtactgcattgactagcctcagctaaggacctggactaaaagataggcacccatgcttactggggaacctcttgagtctttaagaatgtatatgcaagcttcaatcaactgatggatgattcccctccaatctcccttcccttcctcctgctcactggccactggcgacacccccaaacaaaaagctgtgtatacgcaagagggcatatggcacagtgggtgagaacgtaagctcttgagacaggttccgggttctggctttgccacttcgcagctcttttctctttctgaacccctgtgtgcccgttttctcatttgtaaaagaatgaagataatagcacttaccatgcctagcataaactgttgtttcctaaatatatcattttaacaactttattgatatataatttacagccatagggttcaccattttaaagtgtgtaattcatgatttttaacatgtttagggagttgtgcaaccatcatcataatctaattttagaacatccccaaaagaaaccatgtacctactaggagtcactctctatctcctcctgcctctctgccctgcttccctatttcccaggtaatcactcacctactttgtatagatttgcctactagggacatttatattaatgtaatcatacatagacggtttttgtcactgacttgtttcactcaacatagtgttttcaaggctcatccatgttgcaacatgtgtcaacacccaaattcctttttattgcagattaataaagtgtgtggatataccacatattgcttatccatttatcagttgatagacatttggattgtttctgctttttggctatcatgaataatgctgctatgagcattgataatacaagtttttgtgtggatgtatgttttcgtttctcttgagtatatacctaaggatggaattactgggtcgtatggtaacttgatacctaacattttgagagaccgccaaaccatttccattttacattgccgccggtcatgtatgagggttctgatttctccacatccttgccaacacttgtaattgtttgtctttttgattctagtcactttactgggtggtttgggtgggttacctcattaattgtgactttgattttaattttcccagtgactaatgacattgaacatttttcctgtgcttattagtctaaatatactattgattgtaagaaaaattgcttactgttttagagataatactgatataagaaccatcagtccctgctttcattagaggggcaagagtgaggatagttttaaaatcaagcatacttaaagaatcatacctgcatctcattaaaagaaaatgttatttctaggtaaagctaaatcatcattaatgtatagggtttactgtttttctagtaggtttatgtgtagagcactcattttgtttggtttaatctctagttgcttttatgttttaatttaacaaaaatgggtgattggaaagatggaaaatacccttgttgccaccacagtgagttccaatttgatttcagcaacgcgtagaagattgaagtcagatgcagccaattttctcccgattactttttttttgaatcttgcctgaataatgtgagctttttcagctagctaattaacactgtttttttctgccatattggtgactttatgatattttgcttgtaattatatatatattcatttatatacttctaccctattcgtaactttatgatattttgcttgtaaaaaattatatataaattcatttatatacttctaccctatttattaaatgtcccctgcatgaaatatatattaatagctactgcatggattatctttgattgcttttctaataacagttatctggactttgcttggtcttgggtaagaggcatatttgtatgtatattttctcatttttgaaacagaaacataaactgttgcctccgatatatttaataaaactcaccagcactactgataatatttaattatgcagttataattctattcatttttagtttacattctgaatcttaggggcagtgaggcagagtgacatgatcatggaagtatttgtaccacaggggtttgaccttgactctgccacttcctgcgtgactttgaactagtcaaagttaccagttcaaagttagactttgaacgagtctaattgttagagaatggcatgaacccgggaggcggagcttgcagtgagcccagatagtgccactgcactccagcctggtcgacagagttaagacttcatctcaaaaaaaaaaaaaaaaaaaaaaaaaaaacaacaacaaaaaaggaggttacagtctgtttatgttgtctagttactagtcaacactaaccactctggctcggtgttttaacctgtctaatgggtattttttttttttttttaagtcataccatctacctgatgcggtcgttgtgagaacatttcagatagtatttattaaaatatttcctccttggtatgaagtagatgctcaataattgttaggtagcacagattaattatcctttatctaaaaattccaaatctgaaatgctccagtgagcatttcctttgttggtgctcaaaaagttccgcattttggagcgtttcagtctgtcgttccaggggtagtaacagaagctgtcatcttgctggctcttccatctggctgggttgcatgagagttaaacagtaataggagaaatgaaatttcagtaataggcagtctccttagcacaataattggtacaagagagtaagtctgacagtgccagtgaccatcagaacaaaccacagtcattgtggtaaagttgctcgaggcagtgactgaggaaagtgtgtctccatttctgtaacaatgggtagatgtctgctctaaggatttttaattgaggtaaaatgtacagaaagcatgaaaagaatttcatagatgttaagtgcataagccggtaagttttgacaaacgcatggactttgtgaccacctcctcactccagatgaacgtctccatcacccctgcaagttccctcaggcccttccaattaatctccatccctgtaggcagtcgtttttctgatttcttttcaaatagataaatattacctgtgcttgaatttcatatgaaggaaatcaaaatgttaaaagaagaacttcagacaaaggaaatttagcagagtttaattgagcgaagactaattctggaatcagaagcccccaggctagcctaagttcagagtaactcatgctgccacatcatcagataacacttatgaacagaaaaaggaaagcaccataaaagatagaagtgaggtacaggtacagaaacagctagattggttacagcttagcgtctgccttacttgaacacagtttgaacactggccgcctgtgattggccaaaactggtataagagtaggttacaggctgagcgaggtgactcacacctgtaaccccagcactttgggaggccgaggcaggcggatcatgaggtcaggagatcgaaaccatcctggctaacacggtgaaaccctgtctctactaaaaatacacaaaaaattagccggatgtggtggcgggtgcctgtagtcccagctactcaggaggccgaggcaggagaatggcgtgaacccgggaggcggagcttgcagtgagcccagatcgcgccactgcactccagcctggtcgacagagtaagacttggtctcaaaaaaaaaaaaaaaaaaaaagaggatgttacagtctgtttatgttatctagttacagttcactttgtactgagaaaacttctccccttttggtcaacttctccattttcacatcactctttcagtgtcataaagagactgaaacctcaaatcccactgggaaatagcagaacagtgggttttgtaagatagaaacaggacacagaacaccggcggcggggaggccacctgttggttacttcaggttgctttttcgaaagtgttagagagaacttccttattatgctggagtgtcccattttaggaggaaaataacctgctctgttttgagattgatctgtttccttacagtcttagtttgattaggtcgcatttagctcagtgacttcattttggtttggtctggtctgtcggggcctaggggagaggggctcagtgcagtgcaatggcctcccataattttgttggacaatacagtacagacagttttgtttttgacttttttcacccatcaaaatgtctgtgagattcctcgatggtgctgagtttaccagtttgtttctttttattgatgtacgtctctgtcgttttccatgtagggcactataaataacagtactttgaccgtttataaaaaattactcgtgtggatgtatgctttttttcctcttgggggaaatatccaggcctggaacttctggatcattgtgtaggtatttaattttatgataaattgtaaagcctttttctaaagtggttgtaccatttttacatgttcaccagtaatgtatgagttgcagttgctacacctatttgcctacatttagtgttgtttgtattattcaatttagccacttatagtttctgatgtcaaatgatgttgagcagcttcccatgtgctcgtgggctgtttgtagatcttcctttaggaagtgcatgttcaagccttttgctcattttatttatatatttccatttgtcttttctatcattgatgagtaggcattctttatagactctggatataaattcttgcaagatatgcattatcagaatattttctcttactctgtggctttcttattcaactcaacagtgtgtttgttctaaattaagctttttatttttattttattttgagatcattgtagactcaaatgcaattgttagaagtaatacacagagatcccgtgtacccatgtagactctcccaatggtaacatgttacaaaagtataatacggtattacagccaggacaccagcatcagggcagtcaagaccagaatatttctgtcagcacaagatccctgcattgccctttaattgtcacaccttcctcatttcccttgtccccatccctggccctggcaaaccctaatcccttctctatttctatacttttgtcatttcaagaatattatataaaaggaatcacactgtgtgtgaccttttgggatcacatttttgtcactcagcaaaattcactgcaaatttatggaggttactgcaggtatcaatagtttgttccattttattagtgagtagtaaaccgtggtgtggacatataacagtttgtataccattcaccttttgaaggacgtgggctgtatttagcttttggctgtcatgactaaagctgttacctaggaaggtttctgtgtgaacatatgtcttcatttctttgggataaatgcccaagagaacagttgctgggttgcatggtagttgcatgcttgcttttatcagaaaccaccagtctggtttccagagtgtctatagtactctgtgtagccaccagcaatgtgggactaatccacctttttttttttttttttttttttttacatcctcaccggcatctggcgttctcgctgttttttactgtagccattccgatagatgtgcagtgatatctcatggtggtttaatttgcgattctctaatcgttaatgatattgaacatcttttcatgtgctgatttgccatctgtagattctctttagtgaaatgtctgtttatatcttttgctcattttctatttggattgtttgtttcctgctactgatttctgcggattctttgtatattctagatgctagttctttttcagataatgtggtttgcctgtattttctcctaatctgtgtctgtcttctcatctctccgtagagtcttttgaagagcagaaggttttaatattgataaggtttaatttgtcatttttcttttgtgcattatgctttttatgtcaggtctaagagtctttgcctggccccacattacaaatattttctcccatttttttgaaatgttttatggttctacgtttaagttcctggtccattttgatttaatttgtatagaaggtgtgaagattaggtaaatgtttgattttttgccttctaggtattcaattgcctagcatcatttgtttaaaagtctgtccctcctccactgaatttttcacttttctcaaaagtcagttggctgccttgtgttgagtgtttgccagctctctattttatgtctttgatccctctatgaataccatactgtccttattactgtagctagatagtaactttgaaatcaggaagagtgattcctcatattattttgtaaaattgttttagatattctacttccttttttcatataaagcttagaataatcttgtatatatctataattaaatatgctggtatttggacaataattccattacacctgtgtgtctggttgcatagattttacatttttactatgttgagtctttaattctatggacatggtgtgtctcctcatttaattcagtctttttgatttctgttaccagcattttataattttcagcatacaggtcataatttctaaagtttatacctaagtatatcattctctttggagtgattgtaaatggtattatgtgtttcattttggtttctaaatgttcatcgtttatagaaatgtgattgattttgtgtgttgatcttgtatcatgtgaccttgttaaacacattagttctagaagggctgtgtgagtgtgagtgtttagcttctttgggatttcctacatagacagtaacatcatctacaaataataacaattttagttctttccttccagtatgtacatcttttatttatttttattcagtggcgagaccttcctatactatgttgaataggagtgatgagagcagacatccttgattcattaccaagtttacggaaaaatcgttttgtctttaactgtgttaagtgtgatattagatgtagtttttttttttttttttttttgagatggagtctcgccctgttgcctaggctggagtgcagcggcgcaatcttggcttactgcaagctcccgggttcacgccattctcctacctcagcctcccatgtagctgggactacaggcacccaccaccacgcccggttaattttttgtatttttagtagagacagggtttcaccgtgttagccaggatggtctcgatctcctgacctcatgatccggccatctcggcctcccaaagtgctggaattacaggcattagccaccgtgcctggccaatgtaggtttttaaaaattgatttttaaataagattgacagaactcctctctattcctaattcggtgaatagtttttaagatcatgaatgttgtattttgtcaaatgctttttctgcctcaattgatagctcacctaatttttttccttatcccattgatgtggtagattctttctttttttgttttttgaatgttgaaccagccttacatacctagaagatactctacttagttgcatatacgttattttaatacattactggatttcatttgctaatattttgttgaagatttttgggtctaagtttatgagagatactggtctatagtttacttttttgtatttgtcaagattttatatcaaggtagtaatagtcttcaagaaatgaattgggagatgtttctttctctactgttttctggacaaaattatgtacattggtgttgattcttctttaaatgtttggtagaattctccagtgaaatcaactgggtctggagaatttttattgagaagcttttaaattataaattcaatttctttaattgcttatgggactatttggactattaatatttcattttggctgaattttagtagtttgtagttttctaggaatgggtttctatcttctaagctgttaaatttgtgagcttaaagttgttcatagtattctttttttaatgacttcaatatctgcagtgataccattgttggtgttgatgatttgtgtcttctctctttttatttattttagtcttgctagaggtttatcagtttttttctcaaagatccagctttcttatcaatttatttatttatttaaattttattttattattatactttaagttttagggtacatgtgcacaacgtgcaggtttgttacatatgtatacatgtgccatgttggtgtgctgcacccattaactcgtcatttagcattaggtatatctcctaatgctatccctccccccttcccccaccccacaacagtccccagtgtgtgatgttccccttcctgtgtccatgtgttatcattgttcaattcccacctatgaatgagaacatggggtgtttggttttttgtccttgtgatattttgctgagaatgatggtttccagtttcatccatgtctctacaaaggacatgaactcatccttttttatggctgcatagtattccatggagtatatgtgccacattttcttaatccagtctatcgttgttggacatttaggttggttccaagtctttgctgttgtgaatagtgctacaataaacatacgtgtgcatgtgtctttatagcacaatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgctattctaactggtgtgagatggtatctcatagtggttttgatttgcatttatctgatggccagtgatgaggagcattttttcatgtcttttggctgcataaatgtcttcttttgagacgtgtctgttcatatgcttcgcccactttttgatggggttgtttgtttttttcttgtaaatttgtttgagttcattgtagattctggatattagccctttgttagatgagtaggttgcaaaaattttctcccattgtgtaggttccctgttcactctgatgttagtttcttttgctgtgcagaagctctttagtttaattagatcccatttgtcaattttggcttttgttgccattgcttttggtgttttagacatgaagtccttgcctgtgcctatgtcctcaatggtattgcctaggttttcttctagggtttttatagttttaggtctaacatttaagtctttaatccatcttgaattaatttttgtataaggtgtaaggaagggaatccagtttcagctttctacatatggctagccagttttcccagcaccatttattaaatagggaatcctttccccattgcttgtttttctcaggtttgtcaaagatcagatagttgtagatatacatgcagcattatttctgagggctctgttctgttccattgatctatatctctgttttggtaccagtgccatgctgttttggttactgtagccttgtagtatagtttgaagtcaggtagcgtgatgcctccagctttgttcttttggcttaggattgacttggcgatgcgggctcttttttggttccagatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaaggtggattcctaggtattttattctctttgaaggaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcgtctgcaaacagggacaatttgacttccttttttcataattgaataccctttgtttccttctcctgcctgattgccctggccagaacttccaacactatgttgaataggagtgctgagagagggcatccctgtcttgtgcccgtttttaaagggaatgcttctagtttttgcgcattcagtatgatattggctgtgggtttgccatagatagctcttattattttgagatacgtcccatcaatacctaatttattgagagttttaacatgaatggttgttgaattttgtcaaaggccttttctgcatctattgagataatcatgtggtttttgtctttggttctgtttatatgctggattacctttattgatttgcgtatgttgaaccagccttgcatcccagggatgaagcccacttgatcatggtggataagctttttgatgtgctgctggatttcggtttgccagtattttattgaggatttttgcatcgatgttcatcaaggctattggtctaaaattctcttttttggttgtgtctctgccaggctttggtatcaggatgatgttggcctcataaaatgagttagagaggattccttctttttctattgattggaatagtttcagaaggattggtaccagctcctctttgtacctctggtagaattcggctgtgaatccatctggtccttgtattacttttctctgtccctttttactgattctgctcttacctttattattttcttccttaaatttattttcactttccttcttttgaggtaggaaggtgggttattgacttcaggctttccctctttctaatgtaagcattttagtgctatacattttcctctcaacacttctttagctgcatctcacacatattttgatatgctgtattttcattgttttgtatattttcattgttttatttattttttatttaattccagactttttctttttcttttcttttctttttttttttttttttgagacagagttttgctcttgttgcccaggctggagtgcaatggtgtgatcttggctcactgcaacctctacctcctgggttcaagtgattctgctgcctcagcctccagagtagctgggattacaggcatgtgtcactacggcaggctaattttgtatttttaggtgagacagggtttctccatgttggtcaggctggtcttgaactcccaacttctggtgatctgcccacctcggcctcccaaagtgctaggattacaggcatgagccacggtgtccagccccaaacattttttctctgacttgtttatttttaaaaattctgtcattcagtttccaggtctttggagatattcctgttgtcttttggtttttgttttctagttttattctgttaatactatggccagaggatacactctgtataaatttagttcttttaattttttttaggtttgtttactagtctaggatgttttctatcttgattaatgctctatagcacttgaggaaaaaaaaaacaagaaacacacacacacacacacactaggtgtgatgtctactgtataatgtaattgttttccaccttgtggttttggcatttgaaagaacagttaaataatccaaagggatatattgtggaattttaggctgtcaggaagtttttactgtataattctatctgtaaggagaaagcatacgtagctcagtgcttattagattgttttatggtttgaagaaataatgtttcacttaaggaaaaatattctcaaggaaaaaatgcccacagtcgtcagtgaactgctgagtctcatctacttcattgctcaggcatgtaagaccttcctgtttactaataatgttgacttttccttcttattgggaaggaagctaaagaacagcttgatggtttaaaatgatgcacctaaattattgattccattatatatttaggcagtacatttttctctcttgaataatagaaatgtcacctactatttaattttcctttttttttccagagtaattttcactatgtctgattacataattagatttgggataccaactgggtatacttggtaagaaaatgagaattaaaatgtttcagagtaaaattatttcagagcttttgcaaatctttattttagataaggtgatttctatttttaggtttgtttttgaaatagtctaggacatttaaattttaacttctgatcaaattaagttgttttggttcatttaatttgtatgtttcatgtctttgacaaaagttttttttttaattgatgattttttaagataaaatttatgatttggaatgatccaattatctaattccagatgttacttttgaaagatattaatttctaaggtgttaattttgcatttttgtgaaaataacatacacttcatgaatctaactgctaatttaacagctctgtgtggatgtctagtgggtatttcaaacatcctaagttcaacactgagctcttgttcttttcctctgagccagctccttccatcatgagttcccatttcgggaaatgacaactacatctttctggtttttctggccagaaattttggtatcatcattgattcttctttttctcttatgcttcacccttaggccccaggtctgatcaaccattgccacctttactgcaaccagtttaccaaatgaccgtcctttctcatctggattaacaagatggcctcctgagtggtctcccggcttcagcacttgtagcccagttgcatcagggttgagtgcggagtgaggtagtgaagtcagaacttatcaaacttttgctaaaatttccccattggcttccattgtcccttataagtccagggtcccataagacttcttcctcttactttttaccctcatctgtcatcccccgcactcactgcacttcatccaccctggtgtcactgctggtcttagaacacagtggactgactcccacatcagcgactttgtacttgcttttcctgctgtcaggaaacctgagtgcatgactctcttcatcagctgcttccctttcttactcagataccccgttctcaacgaggcctttttaaaacaatcttccttgttgaaaattgccacttcttccccagatttcttttttcctcttcttccttttattttttctatagcattatcattacattatataaaggtgtttctgttattattctgtatgtgtcttcctgaaaaaaaaaatctgtgaaatcataaaccaaaataacacaacttatgaaaaaagttatgtacaacactgaaaaaagtgttatgtacaaaccttcaaaaatctatggaattttgcaatcaggacactaataaagaaataatactactagtaactttcttcattgatttgctgttttgataaaaagagaaagggcttccaagatgcaccttcaacttctctcaatagtgtaatgtcatagaaagtgaagtggtttgtgaagcccctaaactggccactagtcactacctgcactacacaaaggaaggccctttttttttttagtttttaaaattgtaatttgttgtgctgctgctgctgatcatttccttttattttaaggctcacctttgggttcagtgataaagcttgttcataagcaccttagatccttaatattccagggggaaatcatacataaatcactacaacttctgtgttatacaaatatcagttcctatctctcaaccacatatgaagtaatttgaataaaagaaatatgtgcgttagtaaaaccgactatactatatattttctttgtttcctgtttatctccctaaactagaagataagctccatgaaggtgtgatcctattctgtgttcctttttcaaaattctcatttgtgttcccatttcatagacgtttactaggtatttaagaaatatttgttgaatgacagagcaaataatcaaaccaatatctagacttctctagaattctgaagtaattgaaagtatgaatgctttcttttctttaaattgaacaacttctttggcttaatagttagtgacatttaagacggtggcctgatttatgtgtgttatttagaaagccaaaagtaaatgtgttgtggatgaagttcaagatccagcattctgtaggaagatgcaatttcattctgtgacaacatgttttaataggaactaacacgtagattgtgcttttctagcaggtgctggcgtaagcattctgcacacattgggtaatttaatccttgagacaagtctagagcagcagttcccaaagtgtggttcaagaacctgtggcagaccctgagcccctttgcagggggcggccacaaggccaaaatcatttcatcagaatagacctttgtactttgtccccttgttgagcttttggcaacgatttaaaagcagtcgtgagaaaacttctggcacctgagcgcgtatcccgaggcagtggtgccaaactacaccagctggtgtgttactcatccgtgccacacacctatgagtaaaaaccaaaatctagctctctcaaaaatagccttaaagtagtaaaaattattaattctattaagctttgactcaaataaaattattaaaatattctgtgtcgaaatgtgaattacatataaactcttctgctgtacgccaaaatgtgccggttgtctcaaggcaaaggatttgggaggttgtccgagctgggagttgaactggctgcttttttgcatggcaccccatttttacttgaagtagtgactgacagaaaaactatggtaatttagacttgggtattttgcaggattttcttgaaaatgaagaaaataagcttgttgcatcaatgaaaacaactgacagtatttgtggctaaagataaaaattgagctcataagtaaaaattagcattttggaaaccttgaatatgcccaccatgagcttgacactttcgcattatttaaggaggtgtctgatgagataggtagctgtgttaatttgtgatattttttacattgtataatgaaacgtgtcaacgtttggaaggtctgcatcactcagcgaaccaggaaagacatgtgtatggataagatccattccaagtacaggacagtctgaaagatgttaatgtaacaaagcaccaaagtgtcatttatgcggtttcagagtccgcgttgcaactaacctttatgaaactgacacttgtttagttttactaaagtattaacaaaaatattcacagctgtttgaaaaggcaattaaaatactcccctcctttccagccatgtatctgggaggctgtatgttattaatatccttcaactgaaacaacatattacaagagactaaatgcagaagcaggtgtgagaatctagttgtcctttattaagctagacactggaaaaatttgaaaaagggttaaacagtgccactcttaagaatttttagttttcttttggataatatagttatttttcataaatgtcttttgtattaataatgtaatgactttgattttttaaggaattaataactttttaaagttcacaggtttactctctaatatgataaatacagaaagaaataagtcacataaacaagaatttaggtgtccttaatttttttgtatgttgcaaagggatcctgagaccaaaaactttgagaactgctgctcttgaagaagttggtgctattgctttgttgattgagaaacccagacataggggttaagtagattgtccaagatcacagagctagtcaggggagagctgggatttttctttttctttttctttttttgagacagagtctcactctgttgcccaggctggagcgcagtggtgtgatctctgctcactgcaatctctgcttcccggtttcaaacgattctcctgcctcagcctcccaagtagctgggattacaggcacgtgccaccatacccggctaattttttgtattttcagtagagatggggtttcactgtgtttgccaggatggtctcgatttcctgatcttatgatctgtccacctcagcctcccaaagtgctgggattataggcgtaagctacggtgcccagcctccccaccccccgccacccaagacagagtctcactcccttacccaggctagagtgcagtggcacgatcttggctcactgcaacctttgcctcctgggttcaagcgattctcctgcctcagactcacaggtagctgggaccacacgcacacaccatcatgcccagctaatttttgtgtttttagtagagatggggtcttgccgtgttggccagactggtctcaaactcctgacctcaggtgatccgcccacctcagcctcccaaagtgctgggatcataggcaggagccatcatacctggcatagagctgggatttgaacccagggctccaaagtacttgctctaaactcaaatcacatattattacttcttgagaaacctccatggtttgtaactttgctaaaatcaataagctttggttggacttagatgtcctttcaagttattttctcatgtaatttcttgatataaaattaaaccttcaccatgtggatatctgttacatctcagtttttatggcagtacatatttgccgtaaactcaccagcaaacagataagcaggagaaggtaaatcatatttgagattcttttcttggacctttcagttttttatttaatcagggttgatttcttaagattattcgaaagaatctttgaaagaaatattgtgccatattcaagaataatgttggttatttctgataaccttactcttattttggttggtcatactttttcactacaaaccatagaaatgacagttcagtatacttctactttgaagtaaaatattggagagctggaagcttatttcagtttggagaaacgggaattgtatttatcccactgtgtcttattaatttatatactgaaatagattagcacagtgcaagataaaactagtacataaatatagccatatatgtttctaccatcagcttcaattgtggattaatctcactggaagcttgaatggtttcttaggggaaaatattggaagggtaggtttacccccagagttcccttaaatatggtgttaatttgcattgatttcagagaaaacagagaatcagtttgacttccccactggctgactgcataggcaaactattcacagtgctgtttaatggaaatctcagggaccctcctgctttctctgttttcacatggactgactcaaatatggagaggacaccagggacaaattacttggagaaaatcccacacttgttagtcagatttttgagtacaaaatgatgactttgtggtgagatcaaggaatacgcagcacaatctttgacttgtgttagtttttttgtttgaaataagagatatattctttcaattgtagctgcctttcatcctgaaatgtctgacatttattttacaaggcagtagtagagagagataaggtaaaatacagagaagttgggtgggtaatttatttatttattttttagattgacagaagatgatggtacatctaagtatatttgaaagtctaccactgggaagtatttagaaatatttatgataagctaaagaaacaaagcctgggaatttgctgtgataatagagccaactcttttcactggagggagaattacatagtttgggaattagtatgtaccattcgtttatgtcctttttctcctttctcctcctgctcttcctcctcttgcaccgccgcctctagttcacatttaataaccaaacgacttacttgggtggtgacaaaaagggcagcctgaactgccctgtcctcactgccttttctcagcttagcagatagaggactttgtcctaaaacaatcataggtctctttttcgtgtaatgccttcttttcctctgggtagatacccaggagtgggattgctagatgaaagggtagttctactttcagttctttagggaatcttcacactgttttccatagtggtcgtgctagtttacattcctagcagcagtgtaaaagtgttcccttttcaccacgtccctgccaacatctattattttttgatttttgaaaaattatggctattgatcaggaaaatgcaaatcgaaaccacaatgctatgcctccttactccggcaaaaatggccataatgaaaaaatcaaaaaataatagatgattgtggtgatggggtgaaaagggaacacttttacactggtggtgagaatgtaaattagtacgaccatggaatactattcagctctgaaaaggagtgaaataatggcattcacagctacctggctggaactggagaccattattctaagtgaagtaactggggaatggaaaaccaaacattgtatcttctcactcctaagtgggagctaagctgtgaggatgcctaagaatgatacaatggactttggggacttgtgggaaagggtgggacgggggtgagggatacgactacacattgggtacagtgtacactgctcaggtgatgagtgtaccaaaatctcacaaatcaccactaaagaacttactcgtgtaaccaaacaccacctattccccaaacacctatggaaataaaaaaattaaaaatcctatcataggatcctcttacagcatcataatgtggacctgtctatatttgcatatttaactagagtggcacatatctagttatctatttaaacctcaccccagaagtacatttgaaaatcataattgttgtccttaaaaagattgatattactattatgaagaaagcacattgcactgtgagattaaattcctggcttcaataggtatacataatgaactgccagcagctgaaatttgaatgactacacttaccagaaaaggatcttctacccacatttctcagaatagttgttcacaaatgatacattctgccctgtgcttttgtttctccctggaatttgaaaaataaaacttttcgctcatggtaaattcataagcttggggcatgaaaatgtttgaatttgatataaaagaagttttgaaaggaagattagtggtttaaactgaaagattagtcgccctgggaaattcagctgtggcaaaagcggagttcagtaataacctgccctggctgattactccattcacactggcattctggtcctcccggctggactcgcacctgattgacggtgctgattatgatggcttaatacagctcatcgtcacttcaccgggacacgtggactttgtgggcttcacagactaccccccaccccccttgtttgtggtacagttgattcttctgctaagtggaggttgattatttctttattcattatctctttaaaatgcaggagaaaagggcaaattatcaaataggtgatgattatcctagtggaagctctcttgggcagagtcaaaagaagaacttgcagttcaacttgcttgatacctcatagttgattcctattcattctgccgttgaagggtttcagatgatacgacttaattttagctgttgtggaacagcaatgaaaatccatcgcaagaccccctttcttgatgttagggaagccgggggacgcaggatgaggtagtaggctccagctgctgcccatgtgaatgatttttcctctgcagatagatgggtcatggtccctttctagatgagcagaagattattctcacattggagaggtaacattaaatacatttacattggatctgaaaaccttaaatgtttacttagggaagtgtcatcttcacataaaattatgatgttgtgtaagccttcctttttctccacaacctctccagcacctcttattttttggcttttgagttacaggcattctaactggtagcttattttggttttgatttgcatttctctaatggtgggagtgtaaattagttcagccattgtggaagacagtgtggtgattcctcaaagacctaaagacagaaataccgtttgacccagcaattacatcactgggtatacacccagaggaatataaatcgttctattatagagacacaaagacacatatgttcccaatagcaatgacatggaatcaacccaaatacccatcaatgatagactggataaagaaaatgtggtacatatacaccatggaatactacgcagccataaaaactatgcagatcatgtcctttgcagggagatggatggagctggaggccatcattagcaaactaacacaggaacagaaaaccaaataccacatgttctcctcctataagtgggaggtaaatgatgagaacacatggacacagagaggggaacaacacacattgagtcctgttggagcgtggaggatgagagcggggagaggatcaggaagagtaacaatggatactaggcttaatacctgggtgatgaaataatctgtacaacaaacccccatagcacaagtttacctatgtaacaaacctgcacatcctgctgaacctgaacttaaaagttaaaaattatgatgttgtcttgagacaatgttaagtctattcctgtcctttgggcagaccttaaacctatattatccacacagatgagactctctctttcataaatgatttatgttctattttaagaatagaacactttctatatgaaaatggaaatttcacttttccttagtaatttattctagggtcttctaatgttcgttgttagaatacagaagtattcctaacgtctgctcattttcctgaggaagggaatgtctattattatttgaaatacacacacacccttcaaagattaatatgtgggccattggcttttccccaggtcagagttttataactttaccttagaggcaactcaatcattttctttatgaatcatttcaggatgttctctttcccatttaaagtatgtaaagatcaaatgcttttgcagggcatctgtgcagacttgaatactgatccttctttctccctttctgtccccaaagttttgtgttttgttaccttaatgccctcttttaacttgtttacctactgtatgtatttcaatggtaaatagtgctgggctcagagaagtgctattccccaccttggctaatctatgtcaaaatacgtgtcgttatgattttaatttgaacgcttaaaattccagggtgttgacatattttcccttcccttctccttataatgaatgttagtgtctgtgctaaccataattttacggccatttggatctcgagatatttgcttgccagctatatgaaaccattctttaaaatgagctttttttttcctaccagctcacagtatccagccttataatttgtacatggtataggcatgtttgtttaactataaagtccatgaaaaattgagttgtagtatcattttaattcaaatccgttgtatactatattaaaatgatgatgctctatcaatagcaaaaccaaattcagatttttgagtttctatctcgaagcttttccctttcgaaaagatgtatgttttctatgactcattcgtgtaggacactggaaccatatgaagtggcatttctttttctgttgttaaacagagtgcaaatggccagacattaataaagcctgtagctcagtaaatcccacaggatcaaagctacctccattgcagttcagctttattagactgtttgggtaataagaggagatgatttttgctgaagtacataggaaaaaggaaattggacacatggctacattcaaatttaagaatgcagttgatatacagcttaacgcatgtcagttgcagcagaagcaggcagaactcttggaacaggacaaggctcgacaactcctgactttgagttacatgtgctgtcacagcatctaacactttactgcttacattcctgcatcagacctagattataagcgcttaagggacagcgactgtgtcttacactttgtattctcaatgctgattacagaggctggtacatagcatcagtgcatgtttattgaacagaaagttgtacaagtcagagacataagaatccttcttgacatctccctctccctcacatccataaccaatctatcactgaatctttttcccacctaactattgctttaaagcggatcactgcagtggcctctggactggtgtcctcccactattccacgccctctttttttccttctcacattacagccagaatgttcttttaacaacacaatcacacaacctcttcaaaggctttttgctgtctttttttttttttctgagacagggtcttggtctgtcacccacactgccaggctggagtgcagtggcacaatcacggctcactgcagccttgacttccttgggtcaagtaatccctccacctcagcttccttagtagctgggactgcaggtgtatatcaccacactggctaattttttaaaaaactttttgtggagatggggtctcactgtgttgtccaagctggtcttgcactcgagctcaagcaatccttccgcctcagcctcccaaagtgttgggattataggcataagccaccacaactggctgtccttttgtagtaagagctaatcatcatcatcatcatcattatcatattgacagtactttttacaaggttataaatagggtgatcacacacgttgttaatactcggacacttgaatgtgaggtgggcagcatggacagtcacgcaacgatgaggtgggaaccagaacacgtgtggccctgcctgcaaggccctgcacaacctggccctgctcatcccacttccagtcactctctttgcacctgcagaaagtcttgctgttcactctttcgtactgcccaagggtactcgccatgtttgctcccaccagagggcctgcttaacggtttggagtgctgccaacacttttgttctcagctcctgcatttcatctcatcgactaggttaaatctcctactgtaagttcttgccgtactcatagatgcaatttaatatttatttatttgaatgaataaatgaataaatacttgtgagaggttggtaatattgtattactaatataccaattatgatggaatatagtgatcaacaaaatgacaaaataacctatgtatttatatttaaattctatatattcagtttatacactatagtttaatgtgcaactagtttcagtgttaacatttctaatgtgctacttgatgtttattaaatgtacagtagtttataagaacagcttagtaatgtcacaaataaattaccaaaaatttaaagttgagtatgacttcttgaaaagaaattttccgtattaaggaaatatgtgacatttggagtcaaaatatatagaattggtagattctggagctagattatctggatttaaatcatgacttcactgcctactgactgggtagcattgagcaagttatttaacttctccatgcttctgtttattcattcttaaaatgggtataatgatgacatctatgttatagggcttttgtgagaaataggttaatatatatataaggcatttagaatggtttccagcacaaagtaaataataaatactagctattgctgatattagtgttattatatttattcattcaacagatatttattagctatccccttagttcctggcattgttctaggtgctaggaattcagaagtgatcaagactaatgtactgtagagtaacctacaaacactttaatttcagtatctgataactattgtaaatggaataaacataatgacttgttagagcatattgtgcaggaggagctttagttaacctgaaggatgagcaaagatgagcatgcacagagcatcctaggtagaggaaagaccaagtgggaaggccccacagtaggtgtctcactccgttttctgctgctgtaacagactgggtgattcaaaaatgatggaagtatatttgactcttggttctagaggctggacagttcaacaacatggcagttcatctggggaggccctttgtgctatatcatcctgtcatggaagtcagaaggtcaagggagtgcatgagacagaggatgggggcccaacttaccctttttattaggacccctctcccttgataactaactccctcccacagtatcagcattaatccattcctgaaggtagagcctgcatgacctaatcatatcctcaaggtcctgcctcttattactgttagaatggccatcacatttcatcatgagttttggaggggacattcagaccgtaactctaggaaagagcttggcttgggtttaaatgtgcaagaagtgaagtgtgcctggagtgctcggtgtgagcagagaggggaggaggcctgaatgaaagttagaaagctgattatgcaggtggatcttggggacttttgtagaaaaatgacgagtcatataatcctgtttattttgctgataaagaaacaaaaacctgtaagtcctgatgaggatcaggtagctaattagtgatgctacagctagaagccaagtgtgctgcatccatattaaaaaatgttattgaaacagatctacaaaacattgacaaatcatatctagtattctctccattttcacaaagtaaatgtacctttgtaaccacatcaggaaataaattttgacctgcttttcataagccatcccattaccttcacccccgtcgctatcccatccctcagaggtaacccttatccttaacctctgacaccatagattagttttatctggctgtgaacttttatgaacttttgaatagtagcacatgctataagcttttttgaaaattctgtctggcttctttcactcggcttgatgtgtgtgggatttacctgtgttgctatgtgtagcaattgttgctgcattctcgctgcagtgcgctgttccattatgtgaatataccatgagtttcctgtgttgtatcccattgaaagtcaccaggagagaccatttccacgtgtgtatgaaaggaaagctaggttgcgattcatgtcgtttatgtatgtatgtcaatcttgcttatcttacttttttaaaaccaattgaaggttatagaggaaacttctcttttatagcctgcatacacttgactgttttctcgcaaatagattgcctagttaaaaccaaaagcttgtatgtacagggattgtccgatatgtcccttcaataagctattaaccataagtggaaataacttggatgaacctgtcagatgctttcaaatgcgggtatcattgagctttcagctttttgaaatattatctggggtattgcatgtttccagggtttggtaaaggattatttacttcttaattgggccaaacagccatcactttcattttaatattacgtttgtttaaataatagatttattaaattagatgagtgccactttcatgcgtacttcagttttgttttgttttgttttttaatatttcagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtaattgatcgcttgaaaaaataagatcccatttcagttgatgtgtttggaatacttgccttactggtcataatagcacaatgagtgaaaatattggattgaatttctaatgcattcaagattaaaggaatagatttgaatatgtaattagaatgtgatttactattctgatataggttgtacttacacctaggaagtctatcattatatttgtaaaagtaagcccattagtgaaattatcagtcaacaaaaacctatggttacagagcaatgccaataacagctttggtatgatacatttactttccaagggcaacagccctacccacaagtattgctcctgtctaggcacaaatgtttaaacagatctttagtatggtagcttctggagctctgagtagtcagcaaaagtctttcctagctgttttcaagtggagatagggatggatggaatcatggagaatgggcatgcatacagcctgtatattcagcagcaataaaacagtatatattgaagtcctgccatgtgcccagcactgtgccagtcaccagggatctgatgcactggggtggacatgatgtggggacagagggcctgaacctgtggcagagcacaagatcagggtaagactgaggtgtagattcacctggaggcagtagcacagcctttggagcctcagggtcttaccacgcttcagagctttccaggggtatacttttgaggatgataatattacatgctgcagttctgtgcaggatggagaactagcatgccagaaaagtccaggaggcctcaccatcagcaaatcagcaaaatcatcgctgccatgcttttctttagatgaaataagaaagagtgggctgtatagaggcattttaagtggaataacaagcttctcaaatggggaatagcccacccactcactctctttacctctgaggttgtgatacggtggtccgtggaaccacactcagcctgcccagaatttatgtgtgtgtcagttgtctgtgtgtttgtattttaaaaatcaattaaaaaaaatatgagaatgcttacagcattttttttttttttaatttgagacggagtttcactcttgttgcccaggctggagtgcagtggcgcgatcttggctcactgcaacctccaccttctgggttcaaatgattctcctgcctcagcctcccaagtagctggttctacaggcgtgagccaccacacctggctaatttttgtatttttagtagagatggggtttcaccatgttgaccaggcttgtctcaaactcctgacctcaggtgatctgcctgccttggcctgccagattgctgggattacaggtgtgagccacagcatatttttttattagctgccaacatttgacagttctaagattttctgtaaaaaccttgcttcccagcctctgcagaccagtcagaaggcctggctgcctggtctgcagccccaatcaggagcaggcggctgagcagagctgcccccatcaaaggcatggacactccctggttctcctcggtgctctctggcagccccgtcccttgtagcacctcacttgctctccccattcccattacccacccacactttagacaagtgagtgtgtgactgcttacattattgggcctaccctgttggaggatctacactcgaggaaaagtttatcatagtagatcatagcatgttgaaatcaaacagtcctgaatcctaggactggcagaattcagctccaccacacctgagcaatggtgttataactttaggcaggtgacccatgagccctcccctcccgtaagtgaaaagagagtgacgtaagcgtttgcaaaatgggaaagatccctcctcatttgcagtgttgtgagcattgaaggctctagtgatcgtaggcagcattatacattattaccatgtgacattgtaaggctcagtttgttagaaggggtgtaagaaagcagaaacagaaaaagtgaacttagagttgagaaccatgtttgagtagtgactgataacagaagactggagttcagggacttgctcttcaacttaccggtgtgactttggacaagttatctaatgttgatctttttccattggaaaaatgagtacagtaaggcccacatcaccctcatttttatgagagttctcttaaaaattaaattacatagtgctttgtatgccccagaaagaaaggaatggagtttcaaagaacccagattgttcttcctaataagaagtaggcatgatgtggacagtgtgtgacagtggcctggtggccaggctacacgccttggatggcgggaaaggaattgtttcctagatcttcagtttccacatggatgttttctgaaactgaattccccaagaacaggcctttgtgtaggcaccaagccatttctcttttccgaccacctgtaatagtggtttctcctccatcccaggagaaagcgcacctgtaccttatctgagtcttcctgtggaactctctctggggggtgcaagagtaagacagagtaatatcaaagttcccactattaaagaattcttttgatttttaaatggataatatgggtctcaaactattatttgcaaatcgttgaatatacagagggtccccaacttacgatggttcaacttaacaattttttgactttacgcagttgagaaacccttctgttttttactttatagtatttaataagtcacatgagatattcaacagtttattataaagcaggctttgtgttggatgattttgcccatttgtaggctgatattagtgttcggagcatgcttaatataggctaggctaaaccgtggtgtctatgagggtaggtatgttaaatgcatttttgacctagggtattttcaacatacgctaagtttattgggacataacaccttcataaggctagcagcatttcaatttaaaacaattttgtaggcccggcgcagtggctcacacctgtaatctcagcactttgggagggtgaggcaggcggatcatttgaggtcaggagttcgacaccaccagcctggcaaacatggtgaaaccccatctctactaaaaatacaaaaattagccaggcatggtggcgcatgcctgtaatcccagctacttgggaggctgaggcaggagaatcgcttgagcccaggaggcagaggttgcagtgagccaggatcgcaccactgcactccagcctgggctacagagtgagactccatctccaaaaacaaaattttaaaaaaatggtgtaacggctttattttaaatgccaaagtgtacaaaaaactgttatatatgcaacctttcagaattataagacaacttgcagtcaacttaaaactgcaggaagaggtggaacactctttgtattcttaagagcccttgcatatgtatttgttcattggaaacacaagaagacaaaacgttgttggttgtattgaagcaagattgagggagtgactcgttatatgtggactattaaaataagctatgtgcttcactactatgacatgggaaacgtaaggaggaatgggtgattctgaagcaagaattgtttggggtatttgtgataaattatattatgttccacgagggcctcagacacttagatgggttatcaggaatctatcatagcttgcttttttttttccccatgatataaaacctgtctaaaaatctcatactattttttcaaattactctttcatctacttccttccagtaagcatgttcatttatcatatgttagccttcatgagacctttgtaagtttcaaatgaaaaaaacatggatactttatgaaaaaggtagttgtttcccaccttaacaggacccttatttttccccactttggtgtcagttatgaaaatgctaaccctgtaaagagcaaatactacacatttactttttctagctttgacttaaaataacattttctttgctgtgtgcgttacacactgcacagtgaatttcaagtgttgtatttcttttttttttttttttttttgatgtggaatctcactctgttgcccaggctgatgtgcagtggagcgatctcggctcactgcaaccttcgtctcctggtctcaagcgattgtcagcctcctgcgtagctgggactacaggcatgtgtcaccacgcctggctaatttttttattattagtagagaaggggtttcaccatgatggccaggctggtctcacactcctgacctcaagtgatctgcctgtctcagcctcccaaagtgctgggattacaggtgtgagccgctgcacccggcctcaaatgttacatttcatattgatgctcatgtctacattttggtggcacaggtgactacattagcaagttgacggtaattcagcaattaaactaagtttgcatagatatcttaggtggatttgtattctttccagaaagcatttagtctaaattattttctactttggaatgaaaaaatcttttctaattatattcaacatatacatacacctaagccgagaatttcttaatgctaggcacaatatttattattgtaacagaaggaataattgtatactctaaactcctaaaaattttatagttttcttatgtaacctgcctctgtggttcaatttctatgacaatataaaaatagaaatttgatggatgtttattcttgctttattccagggaaaataagaatggttaagggaaaggttatttttttcttttgttttataaaaaggcaaacatttcacagtatcaataaaaattatgaaatacctgggaataagttttataagaaatgagtagaacccacgtggaaagtgcgtaatgagatataaaagatgatacttatgtaggaaacccacttgctataaaaattacagttcctttgaagccatcatagaattttagcctaacatcagtagaacttttcagaaagctaatatcaatagctgattttattttgctgagatagggtctcactctgttgcccaggctggagtgcaagtggcctgatcatggcttacttcagattcagcctcctgggctcaagcagtcctcctgcctcagcctctcaagtagctgggaccatgggacccaccagcacacctggctaagttttctattttttgtgcagatggggttgcactgtgttgcctaggctggtctcaaactcctggcctcaagtgatctgccagccttgacctcccaaagtactgggattacaggtgtaagccaccacacctggcctggatattttaataaaaaatgccaatgggattttctggggaagtaactgatgaagtttttctaaagctcatctagaaatgtaaacagaagaataccaacaaattttcacaacattaagtgaataatggggaggaacttttttttctaaaacccaaggcatattagaatgccataataagtaacatgttaatagtataaaattaaacaatatgccagaggagcattttgaaccagaccattatatttataaaaaatatatgatcaaggccaggcatggtggctcacacctgtaatcccagcactttgggaggccgagggaggcgcatcacctgaggtcaggagtttgagaccagcctgaccaacatggagaaaccccatctctactaaaaatacaaaattagctggttgtcgtggtgcatgcctgtaatcccagctactcgggaggcaggagaatcccttgaacccgggaggcggaggttgcagtaagccaagatcatgccattgcactccagcctgggcaacaagagcaaaactctgtctcaaaaataaaaattaaattatatatatattcaaatgagttctcaaaccaatgctaaaaacaactttttgcaaacattcaaaatagatcctcattaaacatcaaaataaattttagatacaatgaacaattaaatataaaaaaatggaaacataaacaaagggaatatttgaatgatctcagattataccaggagaaagtacaaaagcattgagaaacttcatcagaaaccgatcacagataaatttacaaatatttacaagttttgtataaaagatacaaaatttttaattgcccatttgcttaatcttataagttaaaaggtaagcaacaaactgggacaatatttgcaacaaatcagacagttctgtctctaataacttgggatctcctgatgacagtggtggagacaaagcttggctctccttctttgtttgtgaatgtcatcccaggaagcaggtgtaaaggcaggggaatgaagcagggaggaaggaagcaccagtgcagggatcccttatcaagttggcagtcactctaagtggctggagctcaatcttgtttgcaacgtctatggagtcttatgaaatgcatctcagaagtgcccactctaatgggtgaaagaggaaattatttatcagctcctgtacttggctgataaatatgggtcccatggttattagccttcatttctaattagctcaagcattggtaagcagctaaacctgctggctgtggtgccagagaatccccaggacaggaagcaagaaataggaggcatgggttgaggcaaagtgatgccagctgcgccaccataaagctactcagggctgcctggaagtgttgaccacagcagcagctcaagtaaaaggtagagccagaaggatttttctttctttcttttctttctttttttttttttttttgagggagagggtctcactctgtcacccaggctggactgtagtagtgtaatcatagctcattgcagcctggaactcctagactgaagtgatccttctgcaccagcctccctagtagctgggatcacaaatgggtgccaccacaactagctatttttttttttttagacacagggtcttgctatgttgcccagcctagtcttgaactcctggtctcaagcagtcctcctgccttggtctcccaaagtgctgaggttacaggtgtgagccaccacttccagaccgaaaggatttttaaaatagagagtaagaggacaaaattgagtctattccttgaacccctcagtgtaacttgtacctgctgttaagtctaattcatgaaagagtcccttctaagaagatagtcagctatagtttctaacaaggactttattcaagagagttagtagaacaagctatttttcttactggaccaagtctcaaggctataattggtatttatgttctcctgcccattttaggtatgcataactctcagcctgctcttcagctagtcgaatttgcttggtgctgggtggcccaggccctcatctcaccttttagttgccttgcctttgtagggccatggattctctaattacaactggtcttgcgagtactaagagataccccattgacttctctcctcctcacctctgctgtgtggcaccagccctagtgtcttagagtgattagagtcatttacctccatcagtgtagtaacgcctttctttttcaccagcccactggcatgaagttcacaaagtgagtaggatgaattagagtcaaattctctgggtccctttttcttctataggaaatctcccccactgagaactcagatctgtaatccaaaagagcctaaagttgggaaaaaaacaaatagatggccagaataggggccaatcatatcttgacctcaggttcaacaatttttttttttttattttgagacggggtcttgctttgttgcccacgctggagtacagtggcacagtcatagttcattgcagcctcgacctcccgggctcagttcatactcccacctcagcttcccacgtagctaggggtacaggcacacaccaccatgcccagctaattcttttatttttctgtagacacagggtttcactatgttgccgaggctcgtctcaaactcctgggctcaaatgattcacccagcttgtcctccccaagtgctgagattacaggcgtgagctgccatgtccagccaacactaccaggcattgttccgaatcctattatcctattagtgtggctacttccaggtgatgtaatagctactaggactaccggatcctctggggaaagtgcctgttttcatacctccttcaataagtacaatgagtccctgatctgggacaattctgtgcaggctgccacgtgtataggaggtattcatgcttccagattgcggtgctggcctagtcaatgagcagagaaggcagatccatatccagaggagatcctgagtttgattaggaagagtcactgcatgtttccgtggtagaaaggtcaaatataagcatccagtcccaagtggccagcttgaagaattgtgtcgcactgagggctcagcatcagtctctgccgttgccacgtttggcatctggcattggcaaaagctagattagctttggtgaggaggagctgttgcttttggattcattcatagcctcagtccttgccaacatgaccgattgatgtcccattttattagttgagaagaaatctaaatgacacccacagttgagtcatcctcttcaactgatcgatgagtgccttatctgaagtggatgctctctagtgatataaaaaatccacatattacacccacccccattgggctatttacatatgactttcttgtttctgaatttccagtcctgtttctcccaggcctctttcccatcagccaagccatttgttactgcccaagtgtctctttatatccattctcaagccatttctttctcaaatctctccctattcaaagttaaggaccaaaggtactacttgcagctccgtctgcttggaaggctcttccttaactgcgctccctttggccacgcatgagtaaggccatagtgtgacatcttcattttccggatcaagttgactcatgtataatcccaggcctgagtgtttaactgttctatcaattggtgaggcctgtgtataactgagacagtagtcttactcttgtggctacatagttctgttaataattccctcataatgcttatctccagttgcatattttctttctttcaagatagaatcttgctctgttgcttaggctagagtatatatatatgtatatacaaaatatatatattttgtagagatgggatctcactgtgttcccaggctggcatattttcttaatacctatggggtcaggacttcagtttgtcctaaggacatcagtgtatgtagttcccttctgcagaaggcatgatcttattccaggaccttatggatgcatgtttgactcttctttggggctactagagactccccacaacatccttatccacaacagatatctctggcaacattctatatgctgggatacgtggcttatgtgaaagggcagcttctagaactattgtctaattctatggctgagtcctgtcttcctctttgtctccctaaaaactggcaacctgggtcaagataaagtaactgggatctgatttactgcctcatttgaaacaactgtaaaactggacaaaaatatgaacagttgttttcaagacattggatatcaggcagtgaaagattgtgatcgctgagagatggaagacaaacaaggtgagccctatgtttgccctctgcttactgccttgaggggatttctaggctgtggcacagagaaggaaaacccaggcagaacctagaggaccttctgagttgaagagagctgagagtttggaaagatcaaggcagctagatttcttagggcagggtactggataagagagcactacaggccaagcgcagtggctcacacctataatcccagcactttgggaggcggagacgggcagatcacgaggtcaggtgattgagaccatcctggctaacatggtgaaaccccgtctctactaaaaatgcaaaaaaaaaaaaaaattagccgggcatggtggcgggcgcctgtagtcccatctactcgggaggctgaggcaggagaatggtgtgaacccaggaggcagagcttgcagtgagctgagatctcgccactgcactccagcctgggagacagtacaattctcagtctcaaaaaaaaaaagaaaaaaaagaaaaaaaagaaaaaagcactacacagagaaagaatgctggaatcctccagagggtccccctttaatatttggcagaatattcgtcagcacattcatgtgagaaaactaccccaggcaagggaaaggactatccaagaagattagaggcaatagttccctgtgcttacacaggactcggcggagtgtctgttctcaccagccaaatcgtaaaacctcatattcatgagtttatcagatagcctgcacagaggtgtcttgggtcaggagaatgattagccctagaccaaatactgctctggttctgcctaacaagtcttgaaaagcaagatccaaaaggatcaaactgttgctcaatatcttcacagtatcagagaacaaagttaatgaatatttataggaatgcaaaaatttccagtacccaacaagggaaaattcacagtgtctagaatctaatcaaagatcatcaagcatatgcagatgcaggaaagcatgacccataatcaggagagaaatcagttgattgaaaccaagccagaactgacacagttattagagttaacagagaaagataatgaaacagttataactgtattgcatatgatcaaagtagagacacgaaaaacacaaaaaaggcagaaatctaacttataaggatgaaaactataatgtgtgagataaacattggatgggaccatcaggaaactagacatcacagaagaagatattaataaagctatagtgatagaactatccaaaataaaaggcagatagaaaaaaaatcaaacataatgaaaagggcacaaatgagttgtgggaaagcttcagatggcctaatagatgtgtagttggaatcccccaaggaggcagtcagaggaaaaatatttgaagaaataattttttcaaatttgcaaatcccaattactggagttaccagccagtgcaataaggcaagaaaaagaaataaaaggcatccagattgtaaagaaagaagtaaaactgtattttcaagttacatgatcatttatgtagaaaatatatacttttaaaaagctgctgataagtgagtttagcaacattacaagatagaagatcaacatataagaattaattatatttctgtgtactagcaaacaaatctgaaaattacatatttaaaaatttaaggtaggatgggcatggtggtgcatgcctataatcccagttagttgggaggttgaggcaggagaatcccttgaacccaggaggcagagattgcagtgagccgagattgtgccattgccctccagcttgggtgacagagcaagactccatctcaagaagaaaaaaatttaagatagtacaaaaaaatctgaagtaaggataaatctgacacagggtctgtaaggtctttacactgaaaactacaaaacaatgctgaaagagagaagaaaaagaagacctaaatcaatgggcagatacactgtgtttatatatctgaaggcttagtattattaacagatccattttttccaaacttatcccttggtgatattctttaggcccgagaccctgagacaaattacataactaaaatctaaaattcatcactaagctgtggggaagatttctctacaagatttttttttgtttttggagacagggtgtcactttgttgcccaggttggagtgcagtggtgcaatggttcactccagcttctgccaccccagctcaagtgatccccccatctcagcctcccaagtagcttgggactacaggcacatgctgccacgcctggttaatttttgtatttttaatacagacagggtttcaccatgttgcccaggctggtctcgaacttctgggctcaagcgatccacccaccttggcctcccaaagtgctgggattacagatgtgagccaccacactcagcttctaatgctttctgttttattttcttttaatctattgagctctctctgtactcaccaagaagaaagtctattatatttaattgagaactcttttctcagttggtttcctcatcacccaacctaattgtgtgtaactcccatctacatcttcgtgaaaagggcttaatttctctagttgtccatcttgatgttcagctttcattttcctaaacttggtttatgtcagctctctttttctagttaactcctctttgctcctgtcctctatgaattgcctagctttcaacagcaaggacagcaggtgctatcttatttaatttagatccataatattaatgcggtgtgacctcatgttcatattctccccacaaagttgagtgtttttgtatttctggcttcagtttgactgctttttggaactctgtatggtcataacagatatgaatgtttatggagaatctctgaggcagaattagcattaggctttttaaggttctcattggtaaatgatttggatttagataattattggttctttgtttagggatcattgtggaagctaagtgaagaccttgccagaattgaccaaactactctgtaacataattcattgttgacaaatactcccgagtgagacaagtgggagcttttaaaatttatatttttaatttgcttatgcttataatgtttaatagagtggtttaggtcttttttccattatgcgttggaatggatttttttgattatgtagaaactaacatttgccttcatactttaatccttgatataatggtccccaacttttatgttcatagagaacctggcattataaagaattaagtcaacagacatgcaataaaagatttttatccctaagaaaaggcaatgtcctctttcctgaaggttttctgaaattccttttttaccgacttgagagagcaattaatgctcacagtagatttgacagacggttctagtcatctgtgcttcactaaatatggattgcacattttctgcccctgatttaataaggaaaagtaggaatgaatgacgaatgcataatccccaaagcattgtttattttagagaaaatcacataaacgggaatcccagaggaggagtcttgggaacatttcaacattaattcttaggtctttggattggctttcataactattaatgaagataaagtttaaatgtagtcattcatggtatggcatcaataaaaagttatcgaagattaacatctaattgataccaggagagcttatattcattcaccagatttatattcccaaaaccagtgctacagattccatagaccctcccacacagggacctgtttattgcccttctcaagttaatatgaattttgaaataaataatacacagattaaataacttttacaaatattgtgttccctttgtatagcttccatcgttaccatactgtttaatttaacttcatattgattacttcaattgttttgaaagaactaaaaacataacctcagcttgcctgatgcctagggcctattagtgagctgtatacaccatcaaagtcacatatatatctctctcttaacaaatttcagtttgaattgtccttgtgtttttctgagacagcttgttatggcacagtctgggtttttcatttcattattttgctttaggagaaaacctgctatagactcatcccactttggattttttaaatttcatgtagaaaacttacaaaaataaaattgaaaacaattatttatcatgccattccaaaaagagaattgatgtatttccaagaaggacataaatggcttacagttatttttaccttaacccatatttttttttcattttaaggataagaataggctttggtccaaggtatgaaagcttattatagaacttggttgcttattttcatggaaaatagatattttcataccagcataaaaattaaagttgtggagaatagtcttatctaaagtgacataaaatggatattgacagtccccccaccactgaaagagaaaaatcttacatctaattttaacaaatatgcagatttttttcttatgaatcaaattaagttccctgaccacctaggggaagtataaatgttctcctctgcactgacgctgtggttttggcctgtaacaggtagattcggtcatatcatctggcagtgcttggaaaggactgctgaacagtattctaaaatagtattttgttagatgttttctaaaattttagtggctcatactcaagagaacttcttataacaggtaaatgtgtcccagtttaaggggattctttatcttcccatgatttttagtggtttaccaagagccatgtttttttgtttattttttcttttttcataaaaaaagaaatgattctacgatatattatttaggttttgctatgaccgtggtgagcacctagtaactttagaatatatttcagccaaaattattttggctatgttctagggtgtggaattttgaagggttctaaaaccacagaaaccaactttctcttgtgtgagctgttgcatggatggatattggggtgcccttagaatcagcctggagattgggcaggaacagagtgagccacagtcactctggaactggtcctctgagggtcctgctgctggccccaccaaatactggccatcactgcttgagccactgccctagttggcactggacactcccctactcccctggactagggctccactgtgcccccaccaccgctgctgtcagatgagttctcctttagccctcttcctgggcatcaccaaccccagatttaaaaatccagagcaaatgtgtctaattggccatgctgtgtctcagagctggtacctgtagaggcaggtgagtggtctgggaatatccagatgtggtcttttcagcctttaatttgagataagccccatctccacaaaagctcatagggtggcagattctccaaatacagggaagtggttcagatcctaggtagactgaaaatgtcagatgactagtcccagcagttgttcctgggctgagatggacccgatgctgcctcataaagaaattctagggttggtccagtggtccactcagagatgcaggtcacaactgaggctttctcctattagcagaaatggacatttaagcctttggtttttgtttggattttgtgttttattttctttgccattcctgataatgaactggtcctggaaaacactgtgttagttgagtagaattctgccttgatagagtgaatgcaaacattccctgctgtgttgatttgaaataggaacaggcattttctatactttagtggcatatggtgctaagattttatcatactttcttataaagagccaggaaactttgcctgcttaaaaatgtgtgtttataaacaatagacttacaatgaatattcccatctgttaggtgaacataatttgtgtaggaattcccataataggtggaggactttgcaactttcttcatattttttccttggtgagacattagactaaagagatggtacaaaacagcatatgcttaatattcaattttgtctctatttctgcttcttgtttgaaagcagttctatttttgggcgttagtacggaggattactatagaaattcataagaatttaagacctatttaggtattgaaaaacaggaaaaagtagaatgagcaatcatataaatatggttatgttgcagtgataaaactgtctttgtaatgtttcaaatacatactgcaattacttgtgctatttcttcccaaaaacttttgttgactttgttttaagctaatctcacagctcccctctgttgtaatcacagcatgtaataatcaaagccgcacatactcctggtctggatttgtaatttaaataaatggcattggctctttgcattcaatttgacattattgtgattgtattcaataattaattttgttttagatgaaccattccacataaaagaataaaaattttaagattaaaactcaacaatattttttctctttataaaagattttattaatccttccctaggagctcaagaagattatcagaggggaaaacatagtttgattaatttttgtttaatcttgaattacctgtgttgtccaaatgttttagtcgcttaaaattatgcctatcagttcctttttcaggttgcctaattgtgcatacttgaataaaaacatgagcaattagttgaatataagtgattcaagatatgcttgggaactgagcaaatacagcgtagcatacactttgtcttttactcgattttgaaaaagtttctctggttatactttgtaaaaggaaatacttttaaattgtggacaagtattactggaacatctttttgggtgggtaaagtgtaccgtcactctgttttcttctcccctttttggaaaatagtcttttcctatttgagctccttttcttttcttttttcttgagacaggatctggctctgtcacccaggctggagtgcagtggcacgattttggctcactgcaacctccacctcccggggtcaggtgatcttcccacctcagcccctaagtggctgggattacaggctcacaccaccacacttggctaatttttgtattttttgtagagagacggttctgccatattgcccaggctggttccttttctttcttacggtagacaccttcccatatgtgaaaagcatccaatcctcatgtcttactcttttgttttttgttcaaatatgatgtaccttattcaactgcaatgtgcatatattcatttttattttttaatacgatcaacatagaaaaagctgtacatatctaatgtatacagcttgatgagttgggagataattatacgcccatgaaactttcaccactatatgtggcataaatctctccatcacctccagaagtttcctcctgccctcttcattattatttttgtgtgataaaaacacataaaacttaccctcttagtaaactttaaaatatgtgatacagtatgattcctgtaaatgctatgctgcacagaagctctgcaggactcactcatctcatatggctgaaacttcctgcccttggattcctccccgcttcccctcccctgtacccactagtggccaccatttcacactctgcttctatgaactggactattttacattcctcttataagtggtatcaggtaggatttgttcttctgtgtctggtttacttcacttagatgaacctgcatgacgtcatgctatgtagcaaatgccaggatttccttctttttaagactgaataatattccatcgtgtgtatacaccaccttttctttcgccattcctcagcagactcctgggttgtttccatctcttggctaattgtggataatgctgcagtagacgtgggagggcagacatctgagattcttctttcagttcttgggaaatatactcagaagtgggatttgggggtcatgtggtcattgtgtgtgtaattttgtaagaaacaatttttccatagtggctacaccaacttacattcccatgtacagtagttcctttttctccacgttgtcagcaacatgtgtttttcatttttcgatagtagccatcctaacaggagtaagatgacatctcattatggtttgggtttgcatttccctgatgattagggacattgagctctttttcatatacctgttgaccatttctgtggctttggagaaatgtctgtctagtatctttgccttattaaaattaagttgtttttttaagcttttttttcctgatgcagagagagagagagagagagagtgcgtgcgcgcgtgtgtgtgtgtgtgtgtgtgtgtgttttgagagagtgtcttgctctgtcacccaggctggagtgcagtggtgcaatcttagttcactgcaacctccgcctcccgagttcaagtgattctcctgtttcagccccccaggtagctgggattacaggcgtgtgccaccacacctgctaatttttgtatttttagtacagactgggtttcaccatgttggctaagctggtgtcaaactcctggcctcaagtgatctgcctgcctcggcctcccaaattgctgggattacaggcaagagccaccacgtctggcctctcctgtattttggatattagctcttagctatatagtttgctcacaccttactcttaatttgtctgtgaacgtggctgagaactcaattactctaccatcttgggcagcttagaagttgtgggctccggagttgtaagacgcatttcgagtggcggttggttacctatctttacttgctggtggattttaaaacatcctaatttacaaaaccagcagtaaacctaaggcaaggcttttatagaaactgtatcttttaattatttttttcctttgaaattgtactaaaaaatttagacaggcatggatttgaaggatgattacttacagttacagaagtggaaaatccaaaggaaatgactttttaacctctgaaaaagtttttaaagttaacatcagggaatacgtggagaagtaaggaaaggaagtgaatacattgtgctgagagatgtccacattggtgactggagagagacgccctgatggcattgctttctctgccttgacgagttctgtatctcatcctgaaagtgttgtttgcctcttcctgtggagtgacacaagacatcgtgttaagactgttgccagttctaggaatctttggaaattctgatgttctacagagagagaattataaacgatttttgattgagagggctagtttaaatgcagtgacttttaattatataacctttctcattcaaccagttgtgagttatatctcctgtgtgcatggcactgtgctagataccatggttacagtgatgaataagacagaagtagatcctagctttgggtgatatttaaagcccagttggggagacaggtatcagtgcgataatctcagaaataaagaaataccatttgacccagccatcccattactgggtatatacccaaaggattataaatcatgctgctataaagacacgtgcacacgtatgtttattgtggcactattcacaatagcaaagacttggaaccaacccaaatgtcccacagtgatagagtggactaagaaaatgtggcacatatacaccatggaatactatgcagccataaaaaatgatgagttcatgtcctttgtagggacatggatgaagctggaaaccatcattctcagcaaactaacacaaggacaaaaaaccaaacaccgcatgttctcactcataggtgggaattgaacagtgagaaaacatggacacaggaagggaaacatcacacaccggggcctgttgtggggtggggggaggggggagggatagcattaggagatatacctaatgctaaatgacgagttaatgggtgcagcacaccagcatggcacatgtatacatatgtaactaacctgcacgttgtgcacatgtaccctaaaacttaaagtataataataataaaatttaaaaaaaaaaagaaataaatggtggttctagttagtgtcatggttagggaaggattgcacagatactaggttaccaaaaataaaatatttgttgagcatatactagatgagatgccagtgctgtttgataaaatagcatctgatggttagatataaccatgaaacactggatataagcattaacacttctttttgctattcaacaggtacattattccatctttgcagaagctcgatgctgggttttaccgctgcgtggtgcgaaacagaatgggagcactcctgcaaagaaaatcagaagttcaagtcgcatgtatgtgtacagtaaggagatgtccaaatgttaaagaacaaagtgtcgctggggagtcaatcagaatcacttttcaccattgtaggaactgagagtttatctttggttctattttgagtagaataattgcaaaactcagtgagagataagtaagcagccagcgtggctggccaggtgaggggctgttgaggcaaagggcacttttcttcatttgaaaagactcaggaccctaagaggccctggggaggacgaaaaagtgaatggggtgccttctgttttaggaatcagctgctcttagcttgtactatgtttggattcaaaatgtttttaaagtataaagttcaacccaattaggtcaaagttcgtcattgtcagttctttccagtgacgatttgtttagaaatcatgctgcaccacaaaaggtacatggatagtgagcgtccccgatggcattcatgtgatagtgatttattaattctttattcagcagatccattttggagaacgaaacttttaaaagtaaacaaaggagatatcaagaatgcaggaagcttaaattttcatgtagtcttgaggagaaacaggagagcgaacttggcctatgaaagtatttagtcctttttctaattcaaaatctatgaagagtaaaaatggactgtctgctttattttatgtacatatgtgtatatataatagagacataacatatataattatatgtcatatatatgttatatatataaataaatatatgtttgagatagggtctatctctgtctctcaggctggagtgcagtggcacaaacatagctcactgcaagcttgaactgggctcaagtgatcctccctcctcagcctcccgagtagctaggaccacaggtgtgtgccaccatgcctggctaatctggctaatttcttttgtttttggtaggggagggatcgcactgcattgcccaggttggtctctaatgcctggcctcaagtgatcctcctgctccatccagccttccaaagtgctgggattacaagagtgagcttggcttgttttactatattttgaatgtattaccaaaatttctctttgtttaaaagtaagcaaaaaaatgttataagatgttaaattacattttaatatatcattataaactttagagaacaaaagagctcctgagttgggctgtactatttggtgatgacagaatttcctcatttgtcattttaaccccaattaagtcttgtagctttcagtgtgagtagatgaaataaaataatatctagttattttaccataagcctaatgactgagtgaagtggagatgctatacatgtttgatgctttttaaaatcactaggaaggcttaaatttttctaaattgtgatgccgaagaatgttgcagaataattgagaacttttattcaattgaatgattgaaaatgtaatcattaaatagagtgaagacgaatacctaaattatattttaagaagagcttcaaaattattaaactctgttttataaaactgaattttgcttaattatgtttttgtttctgttctgtatctctagctcttcaatttttttttttcttttttgagacggagtctggctctgtcacccaggctggagtgcagtggcacaatcttgactcaccgcaacctccgcctcctaggttcaagtgattctcctgcttcagcctcctgagcagctgggattacaggcacccaccaccacacccagctaatttttgtatttttggtagagatcgggcttcaccatgttggccaggctggtgtcaaattcctgacctcgtgatccacccgcctcggcctcccaaagtgctgggatgacaggtgtgagccactgtgctctgcgtttagattttttttttttaatctttcttttctcctttgctttgataacaaatttcattttcttttgaaaaaactatgagtatttttctaatctgttttgttggtttgtttcatcttttccctcaagtattagacactgtcacatagaaaatgtcttttgactgaagaagacattgataatagagcacttctgtggactatttcaaacttatttatgtttaaataaaaatacactattttgccatatctgtttgtatatatatttacatctgaccataatatggaatcttattcaaaattttcaaatgttacaaattttaaaattagccttttatacctacattctaatagctatgttttgtcctatgaccccattttttaaattttttttatcagtagaacaaatactggaacaaaagctagttgccccagattaagtcaacagtatgagagtgggagaatagtatatagactcttcagtggttaggaaatattgctcccaaaagatctgtgcaggagacagtgacctcacaaatgaaggaaacaagctgaagagagcaagggccggtgccgggctggaacgagtttgaaagatttaggagctaggagatgtctggacacattttctgacagtttctgagaaaactgcttcacgtggctctaggatggcttcagcatttcatttcagtgtcacagacagttgcagacatttccttgtattgtcaggtaggacaaagaccatgtggctttgctgaggaatgtgcagcgtgggcgctttggaggcgcgtggcttgcccggtgcttcactcgcaagcagatccgcgttggtcagcgctgccgtgcagtctcgctcgtcctggtgtgaaatgtggcagcatcagtgactttactgtaacacttacctgtttccatctgtgaccccttccctcccccaaaaatgttttctagaacttgaaagcacttctttttctctgcagatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatgtaagttgctccaaacgttaaagcttcaaatacaattgtaatgtcacttgctggcaccatctacacagtaagtgtaccaattaaggttaccgatgatttaaaaagagcaaactagtctaggagtcctatcctaatttttaataaacagctatttgaggactggcttgaatatttttaaccagtttaagcaaataactgtctaatattattcttcagaatgttgcatgccctaaaactaaagcagccttacccaactttgcagtccatttttttcttttctgagtgtactttttaagatgtcattgtcatccctgagttgggtttgcctcctagtactaatttaatgagtgctggtatttacttacagtgctgtggggttttttttccccctccttttattgagccatgtttgatactgctttctctgacgataaaacagtaattactgcttatttctctttatccttttatcctaccatgacagttttatttctcttcatctaattagtggttcacccatctattgcagaatagttgctttgtgattagttaggcaagaacatcttgaaataatgcttatctcacattcaagatatttatctaatgcccgacaggttttcttcacttggagctttaagtgattaaaaagaacacttggtatatatttcataactggacattttacaacctaatttaaagacaatattccaaacataaaggtttcaaggctgaacatttccagaagaatcatgaaatgctataagcttaggccagaagtcagatatttatgccatccagtggttgcactcagataaaaattcatcaggagcaaatactattgttgtgctttttcaaaaagaatatgtgtgaggtcatttgccaaatagattttacatctaactgtgaaagtcactgtgggaacccacctgctctctcccctacctgagcatctgtggaatcccttcccgaagccttgtgattctcatctccaaccctacctgagcatctgtggaatcctttcgctaaatctcatgattctcctctccacccctacctgagcatctgtggaatcccttcctgaaggctcatgattcttgtctcccacccctacctgagcatctgtggaatcccttccctaaacctcatgattctcatctacctgaacatctgtggaatcctttccctaaacctcgtgattctcatctcccacccctacctgagcatctgtggaatcctttccctaaacctggtgattctcgtctcccacccccacctgagcatctgtggaatcccttccctaaagctgttgattctcgtctcctacccccacctgagcatctgtggaatccttcccctaaacctggtgattctcctctcccactcccacctgagcaactgtggaattccttccgtaaacctcgtgattcttgtctccacccccacctgagcatctgtggagtcccttccctaaacctggtgattctcctctcccacccccacctgagcatctgtggaatcccttccctaagcctcctgattctcttctcccatccccacctgagcatctgtggaatcccttccctaaacctcatgattctcatctcccacccctacctgagcatctgtggaattccttccctaaacctggtgattctcctctcccacccccacctgagcatctgtggaatcctttccctaagccccatgtctccagtcttctagttctggaccaggatctggctggaacctaaataataataattattattattactattaataattatataatacttataattaataattattattttgagacagagtccctctgtcacccaggctgaggtacagtggcgtgatctcagctcactgcaacctttccctcccaggttcaagcgattctcctgcctcagcctcctgagtagctgggactgcaggtgtgtgtcaccatccccggctaatttttgtgtttttagcagaggtgaggttttaccatgtgtccaggctagtctcgaagtccttacctcaaatgatccacctgcctcggcctcccaaagtgctgggattacaggcatgagccaccacttaagcttatttcacaaatgtttctattttggttattgggaacaaaaatttatatatatatatatatatatatgcatgcagcatattttaaaattctagtaaaaataccagttaccttagaagatgggataattgctatccttttttctttatttaattacaagttacttaggtatccacctttatattgattccaataataaaagatgcctcgagtttcgatgaaacaaaaatgaaggatcaatttttcattcttagtagactgttaggctttaaaaaggcaggtaagggccatttgcggtggcttgttcctgtaatctcggcactttaggatgctgattgcttgagtttaaagcaatctggagtttaaaaacagcctgggcaacatactgaaaccttatctctactgaaaattaaaaaaaaatagctgggtgtggtggcacgaacctgtatttctagctatttgctacttgggaggctgaggtaggaagatagcttgaggccagaagttggaggttgcagtgagctacgatggtgccactgtactccagcctgggtgacagagcaagaccctgtctccaaaaaaaaaaaaaaaaaaacaaaaaacaacaacaacggcggggcagggggtggcaggcaagatacattcttgtataaatattctagaagtttccagtgctgaccacagtatgaccaggcaaacttaggataaatgttgggggagaattggtaccagggatggggggagttagattgaattaggctttcctctcaagcactggagcttttaattaacgtcagtggcagcaaaattcatggtggaagaattctttcaacttagcagcaaataagtctgtattaatctacctgttaacctgtgttctcactatatgcatgagacagcacttattcacgagtatgacagggtatagaatgaaagaacttaatttcataaattttttaaacttgcaaatacatgctaaagcctgtttaattcctggtgagctaataaagtaaagatgctagaagggctttaacttggtgtaatatcaaacaaatggtctgcttacaagcatgaagctgttggtaaatctctaatctcaggaaaataatgcagtataccattttttaaagagatgagatgaggctgattatggatatttacacttttacaaggccctttagtttcgtattttccacctcatcatcaccccaagtctattaagtacctgctgtgcaagattacataaatcagtatggatatgtgtttttctccacaaatttatacatcgtccaaagacatatagctttcacatcccaagtacactgatttgatctttacaaattatatgaatattaaatgatcacatgtaccctgaaactatgtacatctattatgcactaataaaaagtttacctgtttaaaaattaaaaaatctagatgcgaaaacccaatatattgctttccatgtctaagaaagtacagtttttgactgaagatgggagggtatctctgcattcctcgcacccacgggattggtagcacaagtcagatggcatcatatttgttatatacccacagagatgccatttaaaaactagagcatttgactcaaggtgcttcccacatattgaaatgcaggtgaagtttctgcacctattttttttttatttttattttttgagatggagtcttgttctgttgcccaggctggagtgcagtggcccaatctaggctcactgcaacctctgcctcccgaggtcaagcgatgttcctacctcagcctcctgagtagctgagattacaggcgcaccccactatgcccagctgatttttgtctttttagtagagatggggtttcaccatgctggccaggctggtctcgaactcctgaccttgtgatccacccacctcggcctcccagagtgctgggattataggcgtgagccaccacacccagcctttctgcacctatttttaacctccttgtgtgagtttggttccctaatacgtgcacctttgtcatgtggtgaaagcagttcattttctctccccacctccatgtttaaacattacctcattatctgcctttaaaatgtgggctttaggcttataattaaatgattttttttttcattttcaagggaaacagtaagtctaatgttttctaacttgaaaaataagttgaatatcctattaataatcttaacaggagctattatttattgagtacctactttaaacatatcttctctaatcctcacaattgccttctgaggcaggtataattagctctatgtatagttatcagaatggaagattatggatgttaaattacttaccccagggcccccagccaatacacacagagccagggttcacacccgggtctgcctgacactcagtctcatgctcacttctggatcagcctgattctttccactttattggctgataattttttatgtttttgattattttttccatacattgctctagtctttctcatcatttagaagaccagctttcaacttgaaaagacatggattaacctgggtttgcatagaggggttgaaaagtgtcagaggctggtatgttttgaaagtagagacaatctacaattatctcagatactatgtttaattaaaaataggtggaaaaggttaaataccttatgattccactcacacaagataattagagtagtcaaattcatagagacagaaagcagaacattggttgccagggacttgggggaaggagggagtggggagttatgtttaatgggtacagagtttcacaagatggaaagatgtgctgaagatggatgatggtgatgatcgcacaacagtgtgaatgcacttaatgccactaactatacttaaaagtggttaaaataattaatcttaggccacggatggtggctcacacctgtactcccagcgctctgggaggccaaagcaggaggatggcttgagcccagtagcttgaagctgcagtgagctgtgatcacgctatagcagtctagcctggatggtaaagtgagaccctctctctattttttaaattatattttaccacgattttaattgtctttttttttccaaaacaaaaaataacgtcttccaaagacttcccactgtgtacagattaaaatccagattccttcccacattctggggctacagggccagagtctcttgcagtttagcaaatacatcaagctcttttctgttttgaaagttggagacagtcttgctctgtctcccatgctggagtgaagttgaagtggcatgatctcagctcactgcaacctccaactccagggctcaaatgattttcgtgcttcagcctccagagcacctgggattacaggcgtgcgccactatgcctggctatttttttttgtatttttattggagactttgtttcaccatgttgcccaggctggtctcgaactcctgacttcaggcaatccacccgcctctgcctcccaaagtgctgggattacagaccaccgtgcccggccagttttaggtggttttgaccacctaaaatgtttttgtttttctacctacatttggcctcttggtatgcataggagatacacagtgctggaatggctggatgaatgaatgtgaagaaaagtcgtgtaatgtccacagacatcttcagcagaaggggaaaaaaaatgagaacaaacctcaaggaaaaacgctgttgatgaggcagaaaaaatatcttggaaagacgaacagtatattgagagaattgaaaataagttatattcagaatttgaataggtaattacaggttttatctgagaagttgaaaaccccatacatttatttttctgatttactgagtccaaagtttgctatctttgcatatcaaagatgagcttagctttgtcatataaatacagtctaatttgataataaaattgttctgtgttattttggtttagatatattttctttatttccatttatttctcaaaatatgaaatgtgaatatcgatgccatgctgtacttctctttcctccacgacgttatttatgttggtagttatcagattagaacacaaaatcttaactctgtacagtgccattcttgtgcttaattgcaggttcttgtgctcaaattgcatcctgtagcctacctgacaggaatgtgcaagcacaagtattcttgaatgtttttttcctggaaatgcaaagtttatagatgaatgtttcaaaccttcagtcagctttgcaatagacaacttgccagtaatgatctggattgtgaagtatgggcagtaaacagcatcccaggtgactcagaaacagtctgattcataattgtccatgcttaaatacttgaacatccattaacttattaccatttcatttcaatttcttcaagaaagatttgtttaaattagcgcttgcattggaagtcacaacttaatgctcgaatgaagtagatctggttgtaataatgtttttatagttaactaggctttcaaaataatgtgcttttaaaattttatattttataggcattttgtgaatgtttatagagtatatgtgtgaaccgagccatatttggtataagtaaaacagacgagtagatacgggttccaggcctgctttcaccgtaattctgaccttgggaaaattacttattctccctttgcctccattttgccatgtcgatgaaaagggttttctaatcacttctgcaatcctttctggtattaatgttcagtgctgctgttaaggaagggggtgccatggcagttgttcttcccctccctctctttcttccttcatgcatccatggacatttcctgagcacttaattagtgccagccactgttctgcttgccagggacagaaaggggaattgaggcatcccacgtgtgcccctcagtgggtgtgttctgatatgaagcaggtaatacacaggacactttggggtgagggtcgtgctgccacgctgagaagacatggatgggtgggaagagagtcctaagctggagggggttgaattgagtgactaaggacaggtcctctgtggaggtgacattttaaaaaacaccttatagagttataatttgtatataacaaaatgcgcattttcaaagttcatagatggatgaatttcaataaatatgtgcacagaagaaattgccatcccaatcaagagagttcgtgggcccctcctgctgttggtatgcattcctgcagctctgccctcctgcttgtctaatttctattactgcaggctagatgacctgctctagaatttcacacaaatgacatcattgaatatgaaatcctttttctagcttcattcattcaacatcatttctgtggtattctcaatgtgatccttaataataataataattaatgatttttgagtgccaggcactgttttaaggattttatttataacaattcacttaatcttcacggcagcccagcggtttagtactgttattatcgtggctttcctgatgagaactaaggcagagagaggccagcagttggccggcgtgggagccacttgactcctaagtccacaccgttccaccgtgtatatgaggctgttctcccaggttaatgtctgcaagatgggaaggagccagccctgtagagccccagaggatgagtgttctaggcacagaggccagaaacagaaaagagcttgatgtatttgctaaactgaaagagactctgaccctgtatcccctgaatctgggaaggaatcgattttattctgtacacagtgggaagtctttggaagaggttgctattttttgttttgaaaaaaaaaaaaaggcaattaaaattgtggtaaaacatagtttaaaaaaaatagagatagggtctcactttatcatccaggctagactgccatggcatgatcatagcccgctgcagtttcaagctcctgggctcaagccgtcctcctgctttggcctcccagagcgctgggagtacaggtgtgagtcaccatccctggcctaagattaattattttaaccacttttaagtatagttagtggcactaagtccattcacagtgttgtgcaatcatcaccatcatccatcttcagcacatcttttcatcttgtgaaactctgtacccgttaaacataactccccactccctccttcccctagtccctggaaaccactgttctgctttctgtctctatgaatttgactactctaattatcttgtgtgaatggaatcatatggcatttatccttttccacctatttttaattaaacgtagtatctgagataattgtaggttcacatacagtcaaaagaaataatgtagggtgattttatgtaccttgtagctagttttcctgagtgttgagatcttgttaaactgtgttacggtatcacaaccaggatactgactttgatacatcaacaaacagaaggtttctgtcaatactaggatttctcttattaaccttttatggccataactactttcctcttgccctcatccccttcttaagccctaataatcactaatctgcttttcctttctaaagttttgtcatctcaagaatgttgtgtagacagaatcatgcagtatgtgacctgtggggattggttttttttttttttttaacttagtataattccctgattcatccaggttattgtctgaagcctagttggtttcctgttgttgttgtctagtgtttcttggtgtggccataatgtgtagtttataatcattcacctgttgaaagcaatctggattgtatccagtttttggccatgatgaataaagttgctataaacattcttgttccttttttctgtgcatgaacataagacttcattgtgttcatacacacacatgcccaggagtggaatgactgggctgtatggtatttgcatgtttagttttagttttttttttttttttaaatgccaaactgttttccagagtggctgtaccattttgtaatcccaccagcaatgtacgaatgattgcgtttccctgcttcctcactagcatttggtgttgtcatgattttttattttagtcattctcataggtgtataatgatatcttcttgtgtttttaaattttcacttctctaatggctaatgatgttgaacatctcttaatgtgctgattttaaaaagaatgaaattagaaaaaagcaaacttcttgttgtgagaaatgtgttcatttatttgaaaagtcagttgaatgggtgaaagagcagacaatatgcagctaaagtgagacttattgttctgatctgaagaaattactcagaataaaacacagaggaaaaaatatggaaaatctagaaggaaggccaagagatctagaggacagagtaatcaatagacgtccgatggagaaaatgggggatagatactatgcagagaccaatgctatgacgtttcctaagatgatgactcttcacagtccagaagcagaatgagctccaagtaagataaataaagtaaatccaaatctatacatattatggtgtaactgcagaacatcaaagacaaagaagaaaccttaagacaaccatacatgtaattcaggttgcctcagaggaacggcaatcagaagatagctgagagcagtaatagagaacagaggggaatgatgtcttcgaacgccaagggatggaactgctgccatggagttccgtgtcagctaagccaacgatcccaagtcggggagacaggacggtattttcagacaagcctgagaatttatatttccgagaagattgctgaaggatctatgaatgagtttgaggaagaaggatactgaatctagaaggcaatgcagggttagaaatattggcctccgttttatgttctctagttaggaaatatttagtaattggagtgtttaaatatttagatattagatgaggaagtggagacagcaagttgagacaactctttgggcatttttcttgtgagcggctgcagagaaaccgcgcgtgtctctgaggacacgaagtcaagagagctggttttttcttaccatgggggatcccagctattatttatgtattaatggaagttctccagtagagaaggagaatgtgaagagccaggagagagtgaggatgccagggggaacaaagtcctggcaaatgtgacctggacatgcacagacaagcctgggaaggagggcctggagtcatgtggcacggccttcatggtggcatgcggtggcccctcatggcctcacagcttccactctaacaggacggagccagaatatgcgcacggatgcatgtggtttggtaaacgtgcttgtggaaaattgagagatttctcgtggatttttattttctctatgaatatggggatgagtttagaagtttagagtgagggctggtgtgagaagagagagtattaggttatcattcagacagtcagaagcgaactagggaaacatgccagacttatggggacttttgagagcaagggcacagttgcagtttgtggtgatggatatcttcagtaaagtttggaagttctgatgccactgtagagaaggcagctgattgggttcacacaaggttgaagtgtagcctaactaccatgtggaattcagaagcgagggtcatgttgaggctgtctgcaagggagtgatgagtctcgattgtctccgagctttataagagaggaggtgaaggatgttccagtaggatagaatcagaagactgcaggagtctattgactggaagaataattgcagtgggcaaagaagtgggtggactgagcacctcacgtcctctcttcctcactttggctattccattcagtgccaaacagtggacttctcccccacttggaaggaatctggtgacgcagatgagaaaagtcgcaggcttaaacttgtgtggggtgagcttgaatccttagggaatcagcgaatgcttgagtgcaggtggatcagcagacagattactgacgccaccccagctgactgttaggtgacacatagcttcgtgcagcctctctgaagtcatcctgtgggtcacccctccttcctctgtgctttccccttccctcctcactccagggtccacgtgtaagctgttgtaggcgttctgttttcttgaaaaactcggttgtcacttggggtatttgaaatctagacttagaatggcacttttgttgggattgacaaggtttagggagagaccatgaggatgggggccaagattgcatggaggggcagatcagtggtggtgagaagtgtaagactccaaggccacagtgttagagtagatggtaacatggatgtaaagccaccagggagggtggcaggagaagccagtggaggaaggtagggattccagggctacagtcctcaggaaatggagagggaaggaggaattagaacctcagtagggaacagcattgagaataaacgcatcccaatcacatgggcctcagaggaactgggatttggaaggtggaagaggagaaacgggttgggagtgctggctcacagctgtgatgagggtttgctctagctagactagacaaagtgaaggccttctggagctgctcctttgggtatttggctgcaggaccttgcagcttagaatctcacctagtgggtttctgctctgttgcacttcagcttcacttatgaagcagagaggatgatctcttcctcctggagcagttgtgagatttaacagaagagaatgagcaagaaagtggtttgccaagtaatgttcagagatggagagtatatgctatatgccgcccctcaaaaaaggtatgcaggggtgttcaggtaaaaaacgttcatctttctgtggctctctggctggcagtgcacgtagctgtctctgtaacttagagaggacgtgggaggaaggaccctggtgtagagaatatgctggagccatgggcagcccctgtgccccaccgtgcttctgtaaatgtcacactgctcctccaaatgctggtttgtaaaatctagaaagttcttttcgttgttgttctcaccacatccaggaagatggggcacagcgggagtccccttgtctgaactgctcttatcctggggcaaattagtgtccctcaacgtgagtaagaagatggaaagcgccacattgctttcatgaatagtctgcagactgctgatgagctccctgtcaccgcgctttattccagagcctcaccgtgcagagcgagaggtggactccgatgcttgtgaggatttcgtgttttctttcagattgtcaggtagtgcgataaagggttaccttataagcaataataggtcaggatatgggctgttgcccacagtaagtttgacatctacaccatcacatgacgcagttggacttaatgaaggtcactcaagtgtcttctcttttggtgatgcttgttgggcacctgtctgcaggtagatgacactgtccctgctgcttcaggagaaagggcacatcacagatagagaaacgtttctgtgccaagtgaatagcccaagagcatgggggatggggatcgtagaattgcttggttccattcgagttggccatgtagtatctaacttaaatgacaggagtttaatattctatgtaccaatttttcactggaaataaaatacttcatttcacatgagcatatcttgtgacaataatgcatttctttaccaatattagcccattatacatctgaagtcagttgcacataattgcagttcaccaactctacataatactttaattaaaactaggataattaaaatacagttttaatgaacaataaattctgaagttgccaggcctggaatgtgttagttgaatcatagcttgctttttttttttttggctcttaaatctgtacccacattatattttgaaatggcaatgatcacaatcaagaggcattttaaatgcatataatagtatgtactaaaggccaggcaggtgactcacacctgtaatcccagcactttgggaggctgaggcaggcagatcatctgaggttgggagttcaagaccagcctgaccaacatggagaaacactgtctctactaaaaatacaaaattagccagacgtggtggcgggtgcttgtaatcccagctactcgggaggctgaggcaggagaatcacttgaacccaggaggtggaggttgcggtgagccgagatcgcagcattgctctccagcctgggcaacaagagcgcaactgtctaaaaacaaaacaaaacaaatatatatatatatatatatatatatatatatatatatatatatatatatatatatgtatgtatgtatataaaatgtgctagtaaatcatatctttcctatggctgtcttatatatctgtctatccctcttacatacacttgcttatttgctgctaattgtaatcccagaaatgaggaaaaggttttatttttgaaggcccagcaacttaaaacagcacctggtcatactaagtagtgaatatttattgaacaaatagataagtgtttcttggatgaatatataaataatagcacatggtttgttctggggagatggtgtgagactaagtacactagatcgagactcagaaaacaggtttcagtcccggccctgccacgtggtcgctgtgtgaccttgggaagatcagttagctattctcaaggaagttgagataagggtatatatcaaatggaaataatgctggccacctcaccagtgtctgggaaataggattgggtgcgtttatttgataaattgaatatacatgtggaaaccctgtctaaaccgtgaagtacgcatggtgtggtgggattgtgaccccacctctgctcacggtgttctccaattgtctacatgagcacacattagtattcacagccagctgtttctcagctcatttggaactttgtatgttttaggtagtttttgcataatgaattttcagcccttggttggtgataccttgtaagtagatatgccccctccatccttcccttctcctttacttccatcccatttgtaatgtccttgggaaactcaagtgagtcccactgctgttggctcctaagagagacatttttgctgcctgtgtatctgctagatagtttgtttcacagtcaaatataagtgacttttactagcttttttctggactattagtgtcagtgctactctccccaaacacaggtcatttgttcctctgacaaatacctccttgcactgacattttcttctggaagtcactcccgaagtgcaaaattccctcaaaagcaaatgtactttggactctaagggggtactgctggagtcaaaaattaagaaaactttgtaatgctgtttaattcatgacccagacccagggcagggtccttaagagctgcttctggtgacactgcaggatacatctcacctgtacccctgtggaaagccaagggtcagtgggactcaacccatacatgctccttgggaactctctctcatgacaagcctggtcttatctggtcttatctcagggtgttttggtggaaatctttttttttttttttttttgagacggagtctcgctctgtcgcccaggccggactgcggactgcagtggcgcaatctcggctcactgcaagctccgcctcccgggttcacaccattctcctgcctcagcctcccgagtagctgggactacaggcgccggccaccgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggccttggtggaaatcttgactgtcaaagttaccttctcccccacaaaggaggagggggaaagctgccgtctagaaggaaccctagggagaaagggatgtgcttggaggtcaagaagagtcacagggtgtgtgtcccacccagggcattcgtgcaccttagggctggggccatgaggaggctgtaaactggaaagatcaaggcagtcgtacaaagacagggcaaaacatgctaaacagatgagaggcagacagctgcagctgtctggaggtgctgtcacagttggcacccagtgtctacagggtgggttccctctttgtggaaagggaggtagcattcccgggtggggcacagcacaccctgccgagtcctggaaagagggtgaggagcgtcactgtctggaaattcagggtcctacccaaatgtgaagtgtgtggaggcagggtggtgtggaaggcacactggatttaaagcaggaagagggactgtgagagccagctgtgctctctcgtcactttctgcctgtgagcaagcctgacttaatgtttaggggactcgggtttttttccacctgtgaaatggggtcaagccatctgtttggcctctgaggaggtgtggaaggagctggccatcctcaggagggggacattcctggaggcagggccaggcagcgtgcagcctatgcagatgatgtggaggcacgtatgtttttcttatctttctgcgagactactctaaatcttcacgacatgctagtaaagaaagcagaggaagtcttatcacaccaattttgtggatgactgcagggggaaagaaagtggctaaatgatataaggtcaagtcatctgtcagacatagagccgaggatggaggttggcatttgaatgatacctttgtcatcattttcgtgaatgtttatgacaaagtgggtctcagcctgcccatgagggtggtgaaatggccaaagggtcctgcacaggccttgggccccgtgatgcttggtgtctaaaggcaagtgcccgacttcggtggggctccttctcttcatctgtagagtgcaggtgataacaccctggcttgcccgcctcacaggacttttactttggtgcgtgatgatcacatcccctcacaggtgttaagagccctttgtgaatcatgaactgtcatagccgtgaggtggaatcattttctcatgagggcccattctttgctgtaatgagatctgaccaagcctggttctgtctaattcctacagcatttgcttccaagtgacagcccctaatatcgaggtcatccttcatttattctttcctccagtcaatcagtgagcactgtgctaggctctgcggataaaaagatcaatacaatgagtctggcttctgaagggctcacattctgctgagtgggatacagccatcttttagttcatctcatgtagtctttaaggaaaaaaaaaaactttattgagatgtaatttacctaccgtaatgttcacattttcacaaaagcacctaattcagtggtttttagtatattcacacggtagtagagctgtcactactatcttcttttttttttttttttttttgagacagactcacagtctgtcatccaggctggagtgcagtggatcgatctccactcactgctgcaacctccacctcccaggttcaagaaatcctcatgtctcagcctcctgagtagctgcgactacagacacctgccaccacacctgactaatgttttttgtatttttagtagatatgtggtttcgccatgttggccaggctggtctcaaattcttgacctcaggtgatccgcccacttcagcctctcaaagtgctgggattacaggtgtgagccaccatgcctggcccatcaccactatctaacagaatatttccatcaccccagaagaaaaccctgtaccccttggcagtcactcatctttcttcccacttctcaggcctggcaaccacacatctacttctcgtctatatgaatttgcctattctgtcactacctaacatgtgaccttttgacaccttaaatagcctttacccagttgtctttttcgctttctttttcttttgtcctttactgatcatcattaaatatttcaccgggttcttttttggtgcctttcctggactacgttctgtgggggtaaagaagggacattccttctttccttgaatgtatgcttcctgaatgtcagctgccctggtcggtactggtatgatatcacataggttcctgttctcagaatttccagcctggtaaggataaactgaccaaaaaatgggcaaaaaccaaacacataaagaaagtcaggtgatgaaagaaaaccctgtccacagatataatatttataccaaaatttgaagaaagggaaggagccagcgacttgaagaaatggggctggacatctgcgtttagtgtttgcaaaggagctcaggtggcagagagcctggtgtgttccaaggccgaaagggggcctgtgtggtacattctccgaggagagtggcccaaagtgacgtcggcagggactagattgtgctgggttttgtctgtggaaacgagtgaattttctccacgtgtagtggggtggatttataccaggagaaggccatgatctgattggctttaagaaaaccaggctgctttgtgaagaatagagagtaaggggcagaaggagaagcggagagaatacgtaggaagcttctgcaaatgccccggcaagggggactggcagcccagatgaagacagggtggatgacgtggagaaaagtggatgaatgaaagtgtaggttaaaagtagaatccacagggccaaaagagggatttgggatgtagtggagttaagcttcttgcttctgattagagcccttgggggaatcttttacagaaatgatgacaactggattcagatcggatatggggcttgttcagtttgagatgcccgtgaagtatctggtgacaacaattaaccagatgtttgtaaacacacgagtctttagcttaaaggaaagatcagaccggagacagaatattggggacaatttgtatgtaggtgatatttaagaccttggaaatggtgagttcttgcctgcagagagatttcagacacagcaaagaagagaagcaactgctgaggagctctaccatgcagagcagggtagagaaataagacacccatgaaaatatggaaagggacagccagaaagggatggggtagccaggagggcccaataccatggaccaccaagaagagagcttttcacctgattctacataagcagcttgagaaaagcttgagtcaacaggacttgaattccagcactaaataagtaaacaagcaaacacataaataaagtaagagatcaacaaagcatagaaagagaatggggaaataggagggagacagaagtggagagagagagaaagagagagagagatgggagagcctatctttccatatcttttgtcaccttttgagtaaaacctgcccataatgggctcagctccgcagccaggttgaaaaaaggtcctgtttcacgccccaacataaccataaattagaaagccttctggaaaaaaatgtgttgtggacagatgagaaagtttaggatcaaacaaccatagcagcactagctcatgcttcacccaggatgatttctcttcatgttttagtgcttggtctttgtcatcgctgacggaactgcactgttttaccttggaaggttataaatggggaggcatccttagaacttatttatctttgagagcatgaatcttttcttcttcaatctagacttgcccattcattattagatgaggtaaattattatatctgagagatacattatgtcctttggtgatatgtgtatactttaatagtcagggtctgtagtttaatgagtgaagcaattttgagaattacctctgctgagtaatttttggtatttagaaattacttatgtgaagcctgtccgtgttcatggtcatttcaacacctatctctcactctctaaaatcattgagaatccgttattgcctactccagtgatctagataaccatttacctgagctttgttgagttcagtattctagctaaaatcctgtatcacaccaagtactttgaacaactaattgactatacataactttattaacttttttcatatatttttaagtaatggttatatgcagagaaaccatggtttggtttgaatctgctatgtatggattaacattgctggattaaattttagttaaatgtaagaattttgtctatggaaatgcatgcaaaacagtacttgtgctaattaaagttggagagaaaggggacattaacaacctgccgttggcttatctctgatcctctgttgtgagtggaatgtctagttgtgtagtaccccgccttcatctatcacacgctatatgaatttaaataagttgtaaatgccctggatttgatttagtcctttctttgatctagtgatgaaataaggaattgtggctatcattgaatttttgaaaagcatctactgattaaaaattttaaaaactgtttctaaattcttagtgtgaaatgccctcggtttagcattttccattattttgctgtttttaacatcttcaggaatatatatgatttggaaaaatgcagtataaaatggtggctaagaatgtaaactcggaaaccaggctgtctgggttcagaccctggctgtgatacctaatagttgtgtggcctcgggcaagcacctgggcttccgggcaccacactttcctgttgtgtaaagctggtgtagtaataacacctgcctcatagcatggctgagggggttacctgtttaagcacgtgcaactctagagggcttagactactacctgggtgtagtaagaccgttattaccattagtggttctgacaactctcattattattaccacttactcaaatgtttcaaatagaggaagaggcaacggttgtatttttttttttttttttttttttggtgttcccttcaaggaaatcttgcagagaaaattgcattctgtatatctggttactttcatcccatctggaggcacaacaattattttcttaatcctttattcgaacaaaagtccaaattctcaataacaataggtaaaatggaactgatggatcagtgttgaaatgggtcctacgggaaaagttgtaactaagttatgcaggtttgaaaggtatcatcatctgaacatctcacaatactcttcaaaaagacatcctgtctggttacacaaaagatggagcatgagcatttttcacagctcagcactgggagccagggacacatctttgcctagtcccctgtccttgcctgatacattagtcctgaaagtgggaaacccatgactgtagacaactctcctagattctgtttgtcctttgaaaagccccatttagcaaggcagagaaggcagtgaggacccaggctgtcttcctggaggtccagagagaagaagggtgctgacaagggccgctgcggggacgattgggagctcacaggcttgggttcggagaaatggttcctctcttaagagcacaacagcaacaacagatgtttcgggttctttgtcttctaaatgtgtctcacagatgtacagtgtttatatacgtatatacaaattatatacaggttgagcatcccacatctgaaaatctgaaatttcaaatgcttcaaaatctaaagctttttgaacatcaacatgatgctcaaaggaagtgctcattgaagcattttggattcggatttcagactttgggatctgagatgcttaacccagtatgcattatgcagatacttgaaatctgaaaaaatctgaaatacgaagcacttatggttccaagcattttggataaggtatgctcaacctgtaatatgtattatgtatatgcaagtatgcatgcatgcatagatgtgtatgcatatatgtgtgtatgtatcaatcagatagtacacatatttgatctcattttggactttgaaggagtgcataattagattattttgtttccatatttgaaaacaaaatctgttttcaatggtaagcagaaaaattgttgaaacatctgttacagtggcaaaaggctctgactcttgtttaaaatgagtaaaattgtgatacttacttttagagtaagatatataatgataatagtacagtgtcctacatcagagaaatgaacatccatgtttttgttttcaagtgggataattgtaggtggagtgtgtaaaaactgaagcttatttcatgcacacatagtatctgttcccttctggtgtttttaactaaatgaaatatatagggaagtgggattcatgcttgcgatgtatcttctcgacttggggcttgttctcagggccttgcttgtttgcattctgtgatgttgtccgcttagaggtttgttcttcagctgagggacctgaacaacacaatgatgggtaagatgagagagattgctgtttagaccatgtggccagagagggggacagtgtgtgtgacatgcagggtaatcacctcattctggtttgtccaggactgtcccagttttagcactgagagtcccctcagtccctgggcaaaccgagatggctggccaccctacttgtttatagctactgtgggtataaaacttgccacactagaattatgtgttgtccctaccactgtcaaagtctgtacatctaaaaggaagtatggaaagtagaaaactaaatctaagattagctaactatcctgtaaaggctaagcaaggcagaaaggtttcatgaacagaactgaatttcttttcaaagcatttttcttaggaatgtatcattgtcactgtaggaagaagttgatacacttccatggtatgctaggcttataaatttgagaaaaattaaccacaagatatttccgggcccctaacatctcattttgggtacattgtaccttcactctagtttattttccctttgttctttttctggacaacattcaatgcttgttgaaacacacctgttggaattagcccagtgagcatttctcagtttgccactgggagatatttttctttcttcttggtggaatgcttgacaaaaacatacataccttgaagggagtgtaaagcatgaggcaagtcagaggtgtgcggaggagctccgtcactgggagggtcttgaccatggcaaatgttgcaatgaaaaacaccaggctgttaattaccccacaactcagggcaactccagctaaaatgccattgctttgtggcaaagtataacaagaaactcgaatctgtgtactctggtccctgtatgtatattttcttctggaatattacagcctttttcattgtgcttataaatttgagaactagcatccgggcacagtggctcacacctgtaaacccagcactttgggaggccgaggtgggtggatcacttgaggttaggagatcgagatcagcctggccaacatggtgaaaccatgtcttctactaaaaatacaaaaattggccgggcatggtggcgggcatctgtaatcccagctgcttggaaggctgaggcacaagaatcgcttgaacccaggaggcagaggttgcagtgagccgagattgtgccactgcactccagcctgggcaacagagcgagactctgtctcaaaaaaaaaaaaaaaaaattgagaactagcaatagtctgatagagcttttggtctgctttcaaatctgcatgtgttctaataacttggcatctttcttacggctctgagatgaagaaacattgcctccaagaaacagaaactgttactttcatatcttatttgaaaaatggcaatgattttggaggacagtctgtcattttccagaggaacagatgtgacccatatccacagcaggatgattcagaccattataaactttgagtaggctcttctgaataactcagagatccttgagtttacctgaaagtagagaaatgaattaatgatgtaagtctgtaagaaagagtggactctctggctgttgtttttctgaagcctatgaaacctcgtagatgggcccttcctatgtgaagtaggtcccaggtgtgaatgccctctgtgcctcctcaacaggagacccacacatggggaccaccctgtgcacgcagagcagtccactatcatccccacctacagtgatgccttgagccccctctttcactatattttcccgtggcctcacctacaggaacagtttgagcagattctgcaggttgttaacattagagaaaacttgcatgaatctacatatcagttaaaataatgaatagttcttttagtcctgctctagcctctgctgccttatatcacattttgcaattctttgagggtagggattgatttttgttcacctttgcatctcttgtatacaacacaccatagcacaccacacatattgatgttcaagaagtatttgtttggttgaatgaatggagctttgtcttgtgcctgactagttaataaatatttttatgtttgtttccttgtccttctcttttttgcatggggagggagtgccacagcaagaggcaactagaagtagtatttcgtggtgactgcaggacatgtcgtgccattcattgagcattggtgctttctctcacgtggatcctgctgccatctgcagtctttgtttatgctccccttgccctccaaagtctggagacaaaagtgataaagttgattcatgcttggagtatccagcgttccttgtgttgcttttctctctttattaacagatgtagattgacttagtgatgaagatgtttcctcagttggttccatttatgaagggcagggaaactcagaacaccttctaccatcttcccacaatttctcggttggctcacacttcctattccaattagtcagggggttcactctttcttcctgccaccacctttgttctggccattggcataattctgcttagattcctgcaggaaatctcagctgatctccaagtatccagctttgtcctttattcacctcctaatccagttaaccagatgtttctgaaggtggcatatgacacccccaccccactcacctttaaaatccttttagtagtttccgggcctcaagatgaagttcgagcactggtcctcctggccttgtgccgcctgcatctggccttgtctgtcgggcttgtttctccttttcccttcacaaggcagccacgctcagccttgtacactgtcccagctgccccaggtctcttgtcatgggactttgcacatgccgtccccctgcctggaatgccatcaccatgctggattttacttttagcttcagattttatcttacatttcagatctcatcactttctctgagaccatttcccaggctcctgccctcaccctgctgccgacacacagcaggttcagtgtggtttccctggggtctggcgacacctctccctgttgcaggtcttgtctgccgtgtgctgccatggcttgggccttgcttctctgtatatcataagctcctgaggacagacactctgtatctcaggccctaaaatagtgccttgtgcgtcgttggcgattggtatttgtttgaataaattaattgttttatgcctaatattaattttcttttcataattacctgtcaaagtacatttgtgaaaacaaaaaaaatcaaaggagagacatcctttaatgatgtcagtggtgagatcaggtggtccatgccttcctatctcaggtcttgcagggtggaaacgagggataaatgcctgacgtttccccttgtctgcatctgctatccgtcacaagaggtgttggctggtgcagtcacatcacacttttctaaactcagaattgaagtgagttttttatttactttttttttaaggacttgtgtttggtgttttggggtgttcttacggtttgggaaattttatgctaaggacttgttctttccattaagtgctcctagaagaaaaataaatgacaaaagaaataaaaatcccaatgaattgtgacatattgtaatatgtcttgtgcatatctgtgtaccttggcagattattctgacctaactgtagctaattttcatttgagaaatacatgtccatgaagtttatatagtgtgttcaaatgtaattttattataaccatattattataaaaaacacacatttgtatagagaacactgcagcatctacttattccattattacaatggtaacaccatttattttttatgagtcacttgtagaatgacattttggcaataagtcaatgagtttatcatggaaaagtcttcctcccaacctcctcctaccctgaggcttttctattcagagggaatatctttttcaccctcatgcttaagattcaaggatagaattcactctttttgatatatagcttgatgaattttgacaaacatacagtgttgatccactaccacaatcataaaatataaaatagttctatcaccgcccaaattctcccacactccattgtgatcaactcttcctccaccaggagaccctggcagtcacagatctgttttctgtccctatagttttgcattttctaaaatatcttatgaatgggatcctaaagtatttagcctttgaatctggcttgtttcagttctcgtaatgcatctggtactcatctctttgttgcacatatcagtactttgttcttctttattcataagtagtattttattgtgtgcatgtaccacagcttgttattctattccccagttgaagggcatttgggattgttccagttttggccatttgcaaataaagatgctagaaacattcacaaatatgtttgcacatgaacataagcctttattttgcccagttacatgcttggagtagactttctggtaagtgtatgtttatttaactttataagaaacttataagaaacctcaaagtcctcagggaaataatcagaaacttagcttgctatacctaacaaaactatcatttgaggtaggggacagagggataatggcagttttagacatgcaagccattctcattatgttttactgcttaataagctgccctgaaacccatcttagaacaaaataatcaggtgttttgtacacaaatctgcaatttgagcaggagtgggaaggcttatctttgctccacctggtgtcagctagggtggttccactgatggcagtagattcctcttccaacacgactcactttcatggcaaaagttggtattgactgttaactgagagttcatcagagttaatgaccagagaccccagttcctttctacatggacctctccatgggcatggacttccttcaaagattatatgctgggttccaaggacaaacatacagagagaagctgtcacataaaaactatattgccttgggcctggtgcagtggctcacgcttgtgatctcagcactttgggaggccgaggcaggcagatcacatggtcaagagttcgagaccagcctgggcaagagaccagcctggccaatatggtgaaaccccatctctactaaaaatacaaaaattagccgagtgtggtggtgtgcacctgtaatcccacctactcgggaggctgaggcaggagaatcacttgaacctgggaggcggagtttgcagtgagccaagatggcgccattgcactccagcctgagtgatagagtgaaattcctactcaaacaaaacaaaacaaaatactatattgccttttatgatgagccttgggagtcacaaagtgtccattttcaccattgtgtcactagctgaaagagtcacaaaggcctgcccaggttcaggagaaggagccatagacctgtccctgtgtgacgtcatgggaggctctggcagagcatgtctggtaaggaatgttgctgtgccccatttgaaaaggacaattggccacataagggctcaagaagtttaccacttaccaaagctctttgagagaatctaaaaaggacacattccagggagaaaagtaaatctgagaagaagtagaatattaggagtgataatgaacaaataaggtggtaaaacatattggttagtgtaaatgaatgttgaatattttgaaaagcaaagaaatgtggaattgaaatcccaaattataagagcatggaaagcagtgtaggagcagaggggattaaaaacctgttaaagttactgctttgtctcataaacagatacagaaacagattaactacagaccttgttgcagaatttttatatttggaacatgttcaggttttacagcaccttcttacccccttttcattgaactcttgaagatctacttctgctcccaccaaaacagaatcatctttgagttcttactctccttgaacttcgctggtattgactgttcggtttacttccaccttctttaaccactctcttcttttgaattcaataacacaacacactcctgctcattttttctggctctcttcttcttagacctctttgccaacttgccttcctccacctgtctttaaaccttggatttcctcaatccttggtcctagcacttcactacctcccaccttattctccctccttaggtaagttcatccaagctcatcagctcacataccaactatagcacttgcagatgactcacaattttacatctccagcccacatcactcctttgagtttcaaacctatgtattcaacagcctattcattgtattttcctggagttttttcaaaggtgcttcatactcagtaggttgaaaacagaactcttttttcttcattgaccctattttccctgccttactcctggctctcctttcttaacataaatgacactgccatccaacagttgcccaagcaagaaccaaggaattatccttgatacttctttttctcttccaccacatccagtcaatcaccagtttctcttattgtaccacatgttatcccacaaatctactcacatcattgtgtgtccacctctgccaccattcctgaccaaactcttgcctctttcattggtctctaccttgtttccctatgtttattttgtcttctctctccattccccatgctgtggtcagaatgatatattaatatgaacctgatcttgttactctgttccttcaaatccattagtatattagtctgagtaaccaaatccttaatataaacagcagggtttgtgtaattcagttccttcccttatctacctaaattttttcttccatctctttccctctgacgtccagccacagccactttggtatattggttacgttcttagtttcccggatcagatacctgagtttgaatcttaacttttcacttactaggtatgatcttagacaagttcttaaacaaaacaaaacttttattaatggacaagttcttgaacctatgcatcagtgttctcatctctgaaatgcagttattagtctcagcttcttaggggatttgtgtgaattaaatgagatgaaacgtgtgcggtggtagcacagtgactgacagttaataagcccccagtaaatgttagattatttgcttaacgaaccacctcccttcttgtctctgggaattctcgttgctctccccacttatacaggatacccacccgcttgcttcccttgcttagtactgacttatccttctgcagcaaaggaccttacatcccagctggctcaggacagacccagtttatgtctgttgtagatcagttaacatttactgtttttaggtatccccttttactactggtttgtgaaataaattagatgatcacccttttgtgctcagttcaagagtaaccttttttaggaaaccttctttgattcctacaaggacaggtcgtctattatttgttcttacagcacatcctgtaacttttttttgccatagttaccacgattacagttaaaacagttcattgcataactagttccttgaggtttgtttctcctattgggctctaggcccttggaggactgggacctcaaggcggggggtgtcttgccttacccctgagttttcagcattggtcttatccaagtcattactcagtatatttagaggagacaagaaacactgaacaggatctggtttggacttcgtgtctgtttctgactttaaatgtcaagtcacttcctctcactgtctcttcatttcttcatcttgtaaattcagaaaattaagcttaatgttctctagaattccatcggcctctacattgtgtgagtctagcccatcagggacattttttaaaccaatttttaaatatttatagtcacaaatttaagaaggaaatggaatcaatgtacatctccccaaagacagagtaaaatactttgttgctcattgaatgaagctctggtcattaccctttttgttattatgattcctaatttgtaagctctgatgttatcccttctttctcaatatagctgagacaaatgtgtagtctgtatgatcatatcattgctgttatacctatttacaagtttaagactgagtcaatagaaaaaaatccaagtgaagagtgtttaaaataaacttgtgtttctccaggaagttaactaatcaaacacttttcattgtagatgttgtcattcagtacaaaataatccctgagacagtctcatgaaaaacctaatgcattttttggtgagttttataatgagattaaaaagaaattaagagcaggaagtgaaattataacgccagtgggaaatctttgaaaccattttatagttttttccttcttatgtaatatgtctgtgagattgggcaggtttttgtttgcttgcttgcttattgtttgtgtttataatgtggaggaatcagctgaacttgacttatccctttacaactgatccatgcctacacagtagttgcttggagctaaaagcaggaacacatggaccctgaggcatagctgctctgaagtcctggcggcctctgggagggcttatccatgatatgggacacagggtctcctgaggtcttggaggagttttcctggtaactctgaggagtggcgggtcatggtgtggtgaccattggtctaacctgaaggactataggaatgagggcagggagaattgtagggaggcagccgatgctgctggtgagaatgaaaacatcctcagagtggcttccatacccatcctgtttctgtagtgcccagttattgtgaatacccatcacacgttattctatcacagcaagcagctcatctaccctactgcacccccaagttcttgaagtgtctctctgtttcttgccgttactggaggtaagccaacatgaaagatgaaagctgtgtttatacttctactgcaaactcttgaggaaaaaaacagaggcattagccaaaagagataggacatacaggcaaagaagaaagatgagctggaaaccagtacctaaataagtccaaaagcaatctatttatagatcccagagtgagatcgataaaggagatgatgtggagaaatatatatatataatatatatatttatataatataatatataataatatatattaaatatatattaaataaatattaaatttatatataaatttgttattaaataaaatttatattaaataaaaattaaatttatattaaataaaaatgtaatatatatttttataatatataattttatatatatatatatatatatatatatatatatataaaaaatacagaaagctctaagtatgcacagatcacacttttgccaaaataggcacctacaatgagggccccatccccacccttgagggtttggagtgatctttgggtaaaagctctattctaactcttgaaatggttaaactttttctagatgcatcttttaatattacttcctcttttattccttttttctattttttttaaataagcatctttgctttacttcttttagctatgaagcagctcttgctgatagtaaataaatacttaaagtatgaagatacttccttgtagcatttgaccaatttgtaaggcagcggttcctcaatttcagtgatgcaccaagcttttccgaaaatgagttccaaagggaattgatttttatctgcaatactctcatcctacagacaggatattgactacacttgatagaatggaagtgtaaatccagaatgaagcattgcaggaacaaatcccatgggggcggttcatgatcaacagaatcattcattggacggaaagatcggagagctagacagtgtcaatagagacaaaaggggaaataaaagcattcatttcctgaaagagtcttttcctggaaggtttttgttgactggctcttccttttagtatactctctattcctagttgtttatcagcttatgtgagaaccttaaaactcataatcatttataatcaatgtttaaacatggaaaaataaaagtacataccataggccccgccggcctgttattacatgagtttattaacattcactgtgagatgccttggtatagacttacccctttttatttctgtctcatgttgttttggatattctgctttgctaatgcattaggtagtttcgtcttgctctgcaaagacaaaagctcagtcattgacctggagggcccaaaactgcgccccctgctgccttgtgtatttggtggctggcatagtcagttcattatgtggcaggcaaaagtttgcattccaagggcggaagacatacacattggttttgtttgagaattatatcataaaactgagttctaagtacttcttgaacattgagattattattgatgaactgattataaagtattcttaaatataaacccaaagcaaattttattaaaaataaatagaaatttgattaagaataagagataatttctaataactttttggtaggtgacagcagggagatttgtttgatcatggagtttttaaatgcttttaagtcttgaagtccattaaggcatagaagagagaataggagaaaaaaacatctctgaatggcacagaccgatcacatgttgattgaagcacagtcaatgtgtatactgaaattgtgagtcaagagctatatcactaaaagataagggaaagacagcatcagaaattgactacaacaacgaaggtgtagtgggagataaagttagacgacatgagattcagtgttacagatggaggcaatttgagaagaggcgggtggagtgtagtgagcatggtaatgagaaggaaggagggcatctaccccacgtccaagtccaaagcagggtgggagagacctagagagggctgctagggcatgagtgtcagcaggggaggaccagccttcctgttgagcaagaagaagaaacatttagaggagagggtgacaatacaggggcctttgctgaggctggtctttgagtcacagaaagcacaatggaagtggttaaggagttttggtttggtgagggatgtagtgtggagtaagagctgttcatggctgtttggggattcatatacaggagatgagggatgaattgagattctaagactttattccataaatacggacaaagggcagtgatgtgttgttcagtgtttgataactataactggctcttggcagggaagagccctgatgtgtagctttttccaattttcatggtgtgaatactcccaccacagtgtattccaggtgaccaacatgacgtctttctataaggagttggacagagatccacaagattggctctgtgttcagcacgcattgggtaaagggcatggctggattaatgctggtagactcaagccaatcattaggcaaggctgtgagtggtagggagtagagggcatttggtatccttcctgacccctgtggatagaagcatagtgacctgaggaacaatagtcttcttggtgtgtgggccatataaaaacaagcctgcatcaaattctgtacatgggttagagtttgctagccacggctgtaaaccttctcatgcccgtgagccatctccacgtgtgaatctaacagatatctccaatgttgatctccctccatgccccaaacctgctccacccatagtctatatcatatcatttcatggcagctttatctttcaaatggttcaggccaaaaccttgatctttcacccatagccacagaaaaacctgttagctttcctttcaaaagctattcaaaatccaacatttagctgttttcactgctaccactttggaccaagtgatggtcgtctacagctggaattattataacagcttctggtctgtggtctagtcttcttgcttgcttgtattcaacacttagctaatctttttttagaatgtaagttagatcatgtcagtcttcaaaatcagaaatttccagtttcctgtttcattcacattaaatgctggagtacttaaagtggcctacaaaagtctacataatatgctccccattacctttcttcctccccctactcctttttgtttgtttgtttgtttgtttgtttgtaaagagatgaggtcttgttctgtcacccaggctggagtatagtagcatggtcatagctcactgcggcctggaactcccggtctcaagccatccacttacctcagccactacaggcatttttgtagaaactgagtctcactgtattgcccaggctggttatgaattcctggcctcaagtgatcctcccaccttggcctcccaaagttctggaattacaggtatgccatgccccgtatgtcttcttttgagaagtatctgttcatgccctttgcctactttttaattgggttgttttttgcttgctgatttatctaacttccttttatacgttccttatatgttctgaatattagacatttgttgaatgcatagttcctgaatattttctcccattctgtaggttgtctgtttgctctattgagtttctttttttgtggcactatcacggctgactgcagccacaaactcccaggctcaagcgattcttccacctcagcctcccaagtagctgggactacaggtgcatgccatcacacctggctaaattttgtatttttttgtggagacggggtctcactatgttgccacctggctaaattttgtatttttttgtggagacggggtctcactatgttgcccagactggtctcaaactcctgggctcaagttatactcctgccttgtcctccgaaagtgctggaattacacgtaccacacctggcctcttctagtactttttttttttttttttttttgagacggagtcttgctctgtcgcccaggctggagtgcagtggcgcagtctcagctcagtgcaagctccacctcccaggttcacaccattctcctgcctcagcttcccaagtagctgggactacaggcgcctgccaccacgcccagctaattttttatattgttagtagagacggggtttcaccctgttagccgggatggtctcaatctcctgaccttgtgatctgcccaccttggcctcccaaagtgctgggattacaggcgtgagccaccacgccttgccctcttctaatattttttaagcttgaggtcttatatttaagtctttaaaccatcttgagtaaatttttgtatatgatgatagaaaggagttcaattttattcttctgcatatggatatcccattatcctagcaacatttattgaatagggaatctttactccattgcttatttttgttgactttgttgatcagatggttgtaggtgtgtggctttatttctgggttctgctccattggtctgtgtgtctacttttgtattcataccatgctattttagtttcttaggccttgtagtatagtttgaagttgggtaatgtgatgcttcaactttgttctttttgcttctctaacctcatcttttacctacttctgttccctggacataccaaggattcctgcacctcttggcctctgggatgtttgtttcttatgacttcttcaagaaatctgggtggctaattttgtacttttttcaaatatccttttcttagtgaagacttttctggccaccctacttaaacccttggaatttccaactctcccacagggattctgctctgtgtgcgaaggggtatgtgtgtatgtgtgtgtgtgtgcatgtaggtgtgtacactatttttatttaacatacgataagcatctttggccctggattcttcttttttagatgttaatattgttgtattagtctgttctaacactgctagtaaagacatacccaagactgggtaatttataaaggaaagagttttaatggactcacagttccacatggctggggaggcctcacaatcatggctgaaggtgaatgaggagcaaagtcaggtcttacatgctggcagacaagagagcttgtgcaagggaattcccatttataaaagcatcagatctcgtgagacttattcactaccacaagaatggtatgggggaaaccacccccgtgattcaattatctccacctggccctgcccttgacacatggggattattaaaattcaaggtgagatttgggtagggacacagccaaaccatatcaattgttaaatgtaaagacagtgtttatgaattgaaagattcaatatgtgaatatatattttatatcttaatgtgatcttaagacttactatgttgctgtggtaaacaagacagtgtggtattagtggagggatagacacatagttcagtggatggagtagagaacccagaaatatattcacacatggataaccagctgattttttgacaagggtacaaaactccatagaatctgatcagaggctgatgtccagaatgtgtaaagaacccctacaactcaacaacaacagaacaaacaaagtatttccccagagaagatatacaaaaggtcagtaggctcatgaagagatgttcagtgtcattagtcattagtggtcaaaccacagcaggtcatgacattaacaggtcaaaaccacaattagacacaacttcacaccccttgtaacagctaatataaaaagtagaaaattaacaagtgttggtgaggatgtggaaacagtggggtccttgtgcattgctggtggaaatgtaaaatggtttagccaccgtggaagaccgttggttgctcagaaagttaaaaatacaattaacagcaatttcacatctaggtatataccccaaataattgaaagcagagacctaaacagaccttgtacaccaatgtttatagcagcattattcacaacagcaaaaatgtagaaataatctaagtgtccatcagcagatgaatggattaacaaaatatggtctgtaggtaccatggactattatgtgcccataaaaggcaggagctttgaaaaatgctgcatcacgtggacgaactttgaaaactaatcattcactatgctaagtgaaacaagccagacataaaagaacacccattgtgtggtttcacttacatgaggtctctagaatacgcaaattcataaagtcggaaagtagaatagaagtcatcatggccctggggggagggagagatgggagttactgtgtcacaggtacagagtttctgtttgggatgaagaaaaagttctggatagaaatagtggtgatatgcacaacactgtgaatgtacttaacactatgaaattgtagactttaaaatcattaaaatgatagatttcaggcatattttaccacagttttttaaaaagcaattcaggggaggaaaggtgatcttttcaacaaatggtgctggagcaattgggtatcaacaggcaaaataatgaacctgacctaaacctcacattttatatctttaaaaaaacttaaatgaacaacaacaacaaaatgacaaaacatacgagagatttaaatgtaaaatgtaaggttataaaactttttggaaaacacaggaggaaatcttcagagcctacggattagtgaacaatttttagctatggcaccaaaaacatgatcaatacatgaaaacaaaataaattgaatttgatcaaaagtgaaaacttgctctgggacagatgctgcaaagaggaatgaaaaaacaggctgcaaactaggggaaaatatttgccagccacatgtctttcaaaggacttttatctgaaatctgtgaagaactcctaaaattcaatagtaaaaattcctattagaaaatgggcaaaggaggccaggtgcggtggctcatgcctgtaatcccagcactttgggaggccgaggcgggtggatcacgaggtcgggagatcgagaccatcctggctaacatggtgaaaccccgtctctactaaaaatacaaaaaaattagccgggcgcggtggcgggcgcctgtagtcccaggtactcgggaggctgaggcaggagaatggcgtgaacccgggaggtggagcttgcagtgagccgagatcgtgccactgcactccagcctgggcgacagagcgagactccatctcaaaaaagaaaagaaaatgggcaaaggagattaatagacatttcatggaagaggatatacagatgtcaaacaggtatatgaaaatacctttgccatcattggccattaggaaagcgcactttcaaaccacaatgagatttcacttcctacctatcagaatagctaaaataaagagacagtaacaacatcaaatacgtcgagatgtaaagaaatgggatcagtcctgtattgctagctgctgtgtaaactggcatatagccactctgagaaacagtgtggcagtttgtctaaaaacaaaacatacgcttaccatatgaccctatcggtcacacttcttagcatttatccacagaaatgaagacctgtattgacacaaaaatgcacacgcaaatgttcacagaggctttatttgtaatagtcaaattttagagatttatttgagattagtaaaaaaatcagaaaccactcagatgttcctcagtgggtgaaagagtaaacaagccgtggtgcatccgcagcatggaatcctttgcggcaataaaaggaatgaatgaatgaatgaaccaggcaacgacttggctggatctcaggggcatcatgcttagggaaaaacccaatctccaatctcaaaaggctttagactgtgtgagtccatttatattgcattctcaaaatgactcaattacggagatggagaaaatattaatggtcgcagggagttagagacgtaggagagcttgagaggggaggtgaggggagacggctggatgtgaatttaggtggacagcacaggggatctttgtcgtggtaggacagtctgtgtgttgattgtagtgatggttgtataaatgcgcacgtgataaaactgcataaaactatatgattgtgcacacacaaatgagtacatggaaaaatgatgaaatctaagtgaggtctgggtgttgttccaatgactatgcaggttttgatattgtaccatagttacataaggttttactttgggggaaattagatgaagagtacataagacctttctgtacaattttggtatcttcttatgaattattatttaaaatctagtgattttaaaatacaggtttgcatcttttaattattgtcaagtaactatttgcatatgaatgtcaagaaatggaacctgtggcatctgagaatccctaggtttgttgtctccagatgcaactcctcttcctcttaaaggcaacagctatcctgacttatgcgttagccactttgtatttcttattatttatttatttatttatttatgtattttttgagatggagtctcgctctgttgccaggctggagttcagtgatgctatcttggctcactgcaacctccacctcccgggttcaagcgattctcctgcctcagcctccggagtagctgggactacaggtgcaccccatcaggtccagctaattttgtgtattttttagtagagatggggtttcgccatgttggccaggatgatctcgatctcctgaccttgtgatccactgcctcagcctcccagagtgctgggattacaggcgtgagccaccgcgcccggctgccactttgtatttctttatagtttcaccatctgagtatgcccccgagtgctatagtttagttttttgactttatgtaaatgaaatctgactgtgtgaatccttgtgtttctaacttctttgaacatagtttttgtagcattcgtatttgttctggaaagcattcgttttcattgctgtttaagattccattgtgtgtacaccccagtgagttcattcattttaatgttagacttttcctgatgagatgattataaactgctgctctgacctttcctgtacacatccctggtgtacttgtggacatctttctgttgagttttacctcagaatggaattactgggtcataaaggtaggcaagtcttcaaatttatttttcaaaatgccaatttttcaaaatgattttcttaactgtccatttctttcaataacacttaatgtcttttgacatatcatacttacttacagtgtatattatgtgtctcccatcactaaaatataagctccaaagatcatgtgctttttttttatatttttatcccaagtatctagaacagaacatgggacatagtaggcacataataattacttgttgaatgaatacattgaatctatgaatgctgcagccaaaagatagctttctatttattgattaactttcctttcacatgaattggattagaacaaacagaggtataacatttttttccgaacctcttgggaccagatatgttttagaattctgagtttttatttttcatattttggaaagattatacagtccctatactgtatgtagcccagtatcacaagaatggtctctgagagcataacataatcaaatgttttaatgttctgcagtgaaaagtaaatgggagaagaacagactctaaacagccttatatcagttaaagtagttgtttagttggtagaattttgaagtatctgcctgtcagacgaccagtgaagattatgatgctaaaaattacacatcagcatttacaaaaatggtttacctctctctaccactctgtgagatgataggcaacccaggtattattatacccatttcacagatgatattatggaggcaccagaaaatgggactctcaccccatggcttactaaacagcagagctgacacacaaatcttgtctttcgattctgtccagtgcttttcaactatgccacagttgcttcttattgaggaaagcagcaatttttgagatttgtaaattaacatttccagaggggaagaaaactcctctataatgaagctgtcacaaatcatgcactgtcgtcctggtatctggaacaaagctaatggcagcgttcccacggaggcgctcgtatgcactgaactgtccagggtcagaactcacgtgtctgctgcagagacagtgctgagcccccatgcatggggcagtgagccttcagcacggctggcctctccttcctgtgttcttcctttcttgagaatttttttctttttacatcagcttcatagagctgcctgttatactccaacctgctctcctctctcagaaggggggatctcaaatcaagcgtttggatttacagttttttttttttttaaacagagttttgctttgtcactcgatctgatggagttttgcactgccagatcatgcagtggcgcaatctcagctcactgcaacccccacttcccaggttcaagtgattctcctgcctcagcctcctgagtagctgggactacaggggcctgccaccatgctaatttttgtacttttagtagagacggggtttcaccatgttgtccaggctggtctggaactcctgacctcaagtgatccacctgtctcagcctcccaaagtgttgtgatcacaagtatgagctaccacgcgcggcctggatttataaattcaatagcaaatatttctgagagtgattttcaggcacagtattaccgagcaaggcatttacgctgagtggattgattgggagtgaatgtagtgtgtgcagtcttctttcatatgatatttcttgctttttcgtctgtcttttccacaggtaagctacatgagtgtatagctttgtatctgtggtgttttctgatgcttccccaatgttgataacaggacccagcacatactatgcacttgccaaatacttgcttaataaatgaataattatttaagccttttatctttaaaagataatgcctttcagctctgttaacaaaactggtttagacaataggaagcagacagggagatttttgaggcgagtaggtagttttaaacatgccctgtgagaatactcatcagaggttattataatgatttttatgtaatcttctgttaagattttgttcacttcatgaggacaagaaactcacatatacctggtgcatagtaggtgttcagaaactatttactgagctcacgttccatccaggtggagcagccccgttcctcccaggtcctccacctcacagctaacattccctgcgcctaacatggcaagcgtggaagactctggagggtgaaaggagaggcagctgcctggggaccttgggacttgaggcatgaggtgctggtggttctctgagtttccttgttgccttgttgccttagacacatgcattacacggcacatgtcctaacaaggagctgtaaaaacctctaatctggaactagcaatggacacagacacaaaatgctccaagaacagtcctgtttcctccaggcatagggctgggcaaattgtggcctagtaacaaaaaatgtgttggccactcctgtcccaatgcagccacacaggaatgagaaaagcacccccttcatcacctggccctccagctggtttcagcgggcagaatgaaaggtaatgtgcatctccaccgctgctccactcaagcgttcaggtgctcaagttccgctgtggggtggtggtggcaggcctcagtaggagctgatcctccattccctgctcagcagtgacaggtggtacactgatccctgcaacccgtgcagtctcagcaggtctagcgtggagctaagcctctaccccaactcagcatcaggtacttaaggagggtgagagaagctgtgcaagttaactattaagcatcaccccacacaccctttcagtcaggcacagggaggaactgaccttcagtcccaagctgcagctacaaagcaatgggagtcagcctcccctcccccttcctggtggttgtaaagtgcatactgaagctcacccctcactgagaagcagcaaggggagaggagtcagtgcttcccttttgccatgatagtgttggagaagcccagcataaagctgaacacacatacccagccggcctttatgctccacatccacaatgggtaagcccactaaaaagagatgcataggatgcaaaggtcttattatatcatacccaaaatatgtgggatatacctgaagaccatttatcatacttagaaccagcagaatcacaacttgaatgagaaaagccaattatcagatgctaaatcagagatgaatgtgatgttggaataatctggaaaatattttaaagcagctagtcataaaagtgcttcggtaagtaattttgaattctcttgaaataaatgaaaaaaaaaaatagaaaatcttagcacagaaataaaagagccaatggaaagcagagaactgaaaaatagaataaccaaaataaaatactcattagatgggctcaatagtagaatagagatgacacagaggaccgaatccatgaacttgaggacaggtcaagaatgtagccaatctgaacaactaagaaaaaatagattggacacaacaacaatggacccaaagggacctgtgggacaagactgagaggtaacattggtatcatcagaattcataaggagatgagaaagaaggttgggctgaaaatgtttgaagaagtaatgtttgacagcatctccgatttggtaaaaagcctaaacctataaattcgggaagctgagtgaacctcaaataggataaatgcaaataaatttataccaagacacatcataaataaacttgtgaacattaagttaaaaaaaaaaagagagaaatgagggaatacttataagggcaggtgaaaatgacagcagtcattcgaaactatggaggctgggaggaagtagcaaatttttcaatcaccaaaagaaaagaactgtgtacagcaaattttgcatctggtaaaaacatccttcaaaaatgaaaggaaaatcaagatgttcctaaatgacagaaaggtaggaaaagatgttagcaaacctgtcctattggggaagagctgcataaaatattctaaacagaaataatagaataaaaacccggactttagaaagaaaagaatgttggagcgcagaaaaataggggcaaatataatacacaatcaaacttctgttgaggttcatatgtgatggttgatgcaaaaattgtaactttatgtgctactcagtgaatgtagaagaaatatgtaaaacaattacattttagaagtagaaaaggaaaggaacctaaatggaagtaaggtttctacacttcaaagtatcatatatgtacattgtgatacccatataaccactaagaaaactatccaaaatgagatacagaaaaacgttagaaataaatcacaacggacttctaaaaaatactcaacctataggaagataagaaaagagagaataataagaatataggaaaataataaaatggcacgtttaacatgcatatcaataattatgttaaatgtaacagatctaaatataccaattaaaatacctagatttatagaatgaatgaaaaaaatgacctaataatatactgtctacaagaagctcacttaaagtgcaatgacataagaggacagaaagtaaaagactagaaaatgacatatgaggcaaacttttttttattttattttttgagatggagttttgctcttgttgcccatgctggagcacagtggcatggtctcggcccactgcaacctctacctcctgggttcaagtgattctcctgcctcagcctcccgagtagctgggattacaggcatctgccaccattcccagcttatttttgtatttttagtagagacggggtttcaccatgttggtcaggctggtcttgaactcctgacctcgggtgatccacctgccttggcctgccaaactgctgggattacagccataagccaccatgcctggccaaggcaaacgttacttttttaaaaatgcaggagcgtctgtattaacatcagacagagcatatttgtattaggtgtccagggctgcagtaagaaagtatactcatgggctgtacaaggacacatatgcctgtcactcacgcatacatacattgccagtgataatgtaaaacaggacagtcaatgtgggaaagaatttggcagtttttcataaatctaaatatgcaggtactatatgctgtgttctaaaattgaaagattggttgggtgacaggacacagcgcactgaccctgagttagaaagaagctacgactctgttgctgacagctctgaaggagaaggccaggccaccagcaggaccacatgggatcaggtaatggcaggcaggagctgcaggggacgaggtcagcttatgtatggaaagcatttagttaattttctcaggatccctgtggattggagagttggaataatttcagtaggttccagggcactggggcagtcccttgttgtctggtgcctggccctggagcaactggggtaggcaggtagtggccctggagtgtgagtgcccagtaagggaagtggttgggatgggaacttcaacttgatctgcagctcaagaagggagatctgagtggcttctagccagaatctccaaactgggttgggatagcatcaaaacacacacacacacacacacacacacacacacacacacacacaccaccctgtatcacatgggcattgtttccaagacaaatgaaaaattatgttcacacaaaagtctgtacacaaatgttctttttttttttttgagatagagtctctctctgtcgccaggctggaatgcagtggtgcgatctcagctcagcctcccaaggagctgggactacaggcacacgtcaccacacccagctaatttttgtatttttaggagagatggggtttcactatgttggccaggatagtctccatctcttgacctcatgatccacccgcctcagcctcccaaagtgctgggattacaggcgtgagccaccccgcccagccccatagcatttttattcataatcaccccaaactgaaaacatcccaaatgtccctcagctggtaacagatatcgaaccgcagtccatctgtaatgtgggacgctgcttcgcactgaaaaggtgtgaactgtcgatgcacacggcaacttggatgcatctccaagaaatggcggtgatgaaaaaaattcagtcccaagagatcgcatatggtacggctccatttatatggcattgtgggaatgacagaattatcagagtggagaacagactagaagtctacacgggtcagcaaagcagcggagagaggatagagctggatgcgatcatcagaaagtaacacaagaggtccttgcggtgatggaaacgctgtgtgtcttgactgtgttaatgtcgtatcctgctcacagtgctgttctatacttccgtaagctgtcgtcattgcaggaacctggataaaggtacccaggattgctgtatttttcttacagctgcatgtgaatctgtgttatctcaagagcttagagtaagggaatgagaggagaaacatggcaccctcaaagattattagagaaggttctatttccaaagattagaggatttccaagaggaaactactctggaaaggatttttaattgcatttagggaagccagtgtactaagagctgagacaatcagtgctcagtgtagtaatgatacagctacttcctaactcctttctgggtgctataaagacaaagttaattgtatcattactatttcaaaacaactgaggcttttaaagtgtttcttaggagtgttacaagcctgtctgaagtcctggagagcaatgaagtgtagatccaggaggctgcagtcaatgcagtgtggtggttgagagaccaggccctgaaatcagacctgggtcaaatttcggctctaccagtttctggtcttacgccctttggcaagttagttaatcttttgaggtttaattcttacatgtagtatgagaactgagaagtaataactgtatctatactgaaggagtgttataaagaataaatgagataattaacacaaagcacttcataaatgctctacaaatgccagctttgctgccgttgttagtattataattagaagcaggagcagtagtggtgcagaggaatccagagacaaatttcgtctttgtttctaacagcatgatttctagaaagtcacttagctttgcagacctcagtttcctcatctagagttttagtatgttggagtagatagtatgtaaagtatcttccagtgtttatcttcttggatgctacagtgaactttttagagggaaaatactacagcggctgaaagcacaggctgaggagtctttcaggcctcagtttggatcctgcctccattctgaggcacacaccgctcatggccaatccatgtcctgtgtcctctgccttccttagagtttgccattttgttcagaacagcactgtgagctccctcccacctccccgaccctatgatgaatcatgattgctctaggacaggtcagcagactactgcccaaggggccaatccatccatgttcccaccttctgctatacttgcgttcctgtaaataaagttttattgtaacacagccacccattcatttatgtgtcacttgtggtggtttttccagttctacatgtggagttgagtagttgtgacagggatggaccatatggcctgcaaaccctaactgtttgctatctggccctttacagaaaatgcttgccaccctctttcctaagaacgttatgataaccctgcttctgtcaggtttccagcttcccttgcagctatggggacctgatgattcacctctcccacaaagatgtcagcccgagccattggagcctgctattctccctcctccctgttcctgttggattgtgtgcagttgtttctaagtctagtgcttataggtgtagctaccatcctgccgttataagacagtaaacctggtacaagctaagcagggtggaacagagagagggaggggcctgcattcttgacagacattatcaagttcttgtactggctctggattccctacgtgtagtattttttgttatatgagaaaataatctcttgttttttaaaaaggacttttaaaattatttgttgtggctgcctgtaactaaatgccatccacctattacagactttttactactggtgaaattttgaacaaattatttaattttactaggcctcagatttcctctctgtttcttactttagtaatgaggattaggttagatgaaaaatataaggcttttgctccgttcctactacagaggaagcaaataattggaagttattatttttatttcccaatgaatccattcataattctaaattattttgagtctgtgtctacacaggcccatatctgccaaattaccttttgcaaaaaaccatgttttatttagaaatgctttgacagccagaacatgtgtgtctattgcaaacaaaaatattttcagtttagaaatacttgttttgatcatccgtgtggaaatgaatgttttgtatttgagttgttaagctacaaaatatatttgctaaatgtttttgcaaaaatattcatccatttcttagaataatgccttagagaagcacccagtggtaattatgttcttaggcatgtttatgacacagaacagatcgaaccttttggaaaaatctggaatggaagctgggactaatagcccagtgactctagatgcagggcgtcacctacctcatcacgacgctaatgtttccagggcttgctagttgaatttccacatgacgattagcacaaatccagaactaaatgacaggttatacttctgtctcaagcatcatatgatattgatttttttttactgtaactagaaatttttttcctggagggtcatgagaaaaattgtattttttgacaaaagtataataatttacttgagacttattgttaatgttcagtgatagtggcagggatttatccttttataatccttacattgtttctctttcaaatttttcgtgtagggattataaaaataaacccactggatagcttgtaccttttgctggcatttaggataaagagaaacccaataaatcttgcgtcgagtggcctcactgatattgattgaattataagatcatagtatagcttttacagataagtcaccaggaagacatcacacaatgttgtttatagaaagtaagaaagcaggtcttcttttgtaagattccatattaatcttaacccccgtaacattatactgatatatttttcaagttgattataactctctactacaaggtcaaaataaaccttatattaataaaaaccatatgacttgtctttagacatccaagaaaatttaaaagtaatactttgcgtgtatataagaactttcataatagacagtctcaaaacacttcagaaataaaatacactcatattatagcctggatgtctataggcattcactgggctaatgtttccttccaggactctgtgaccttctagaattactcaaagacagtgtgtttgccctcactggttgattttgtccttcaaagaaaattatttggaagaaaaaattttcaacttattagagaaaaatactcatttctcattttcttatcatttgacaggaagcttaccaatttattgtagataattacaccaatgtttcattccttagaatcacctttcaacatgaattcaaatgtatacgaaaagcaatagagaattctggactttagatttgcaagaaataaaaaggctccaattttcttaagttgttatgattaccacagagtaaaaaatgccatagaatgaaaatgtcttatgttgataggaagaggtcagggctcttactcgaagtacaagataaatcacaggcttaattttggatcacagtggacccctccctccacttcagctgtggaaatacaaagaaaagagttgcattgaagaaacaactggagtccaagtagcactttgcttccgttacaggacttggagcatgttataaatggctcaaaaagtaggatactctctccccttttcagggatctgtataaggaggcagtcatattcaaaatacaaagtagaagataaatgttttctgccggcatgatattttaaaaggaaaaatatgattatctaccatgatgcattgtgaactgatattattgatttttcctcttgtgaccttggttgcacagcaccaacacaaacacacaccccttgctggaaggtctagtttcaggtgtgaatgcgtagaagtcagagatttaaaaaatagggggcttgtagtatttgtttttgccttaattaagagttaatacttggcttatctacttactcattcagacagcgtgggttgaaaatgtattataaggcaggtaatgtgaggcaatgggggtgtctttaagaaggtaatagcttatctgagccttttatcctgcaggattcactatgaccttgcttttccactcccctcccgctgggtctttcagtctgtccccctttatttttgcttactcattcatgagtattcattaaactcctacaatgtaccaggcactcagaatatagctgtgagcaagacggttatgcttcctactctcatttagcttataattgagttggaagacagacattaagtaaatacttatattaataattttattgtaattatgatttctgttcagagacccaacataatttcaagtttccattttttcttaaaaaattctttctgattctaaaactttatagacaactaagaaaaaaataggaataaatcaggaaaaagtaacctaagatatcccaccagcccaaaataacttgttactatttaaaatgctttttcttgcacttttctttagtgtgtatatgtgtgtgtctgtgtgtgtgcacctgtgcccatgtgtatttagaatttgggatcatactatatagttagttttgctattctctttaaatgatcattaaacagagaggatttcttatattacatatttttcaataacatattttaagcttgttgaataatttgtattttagttatgtagcataaattatttgtttatttgggtacatttcagttatgtccttcaatttttgtgcttatttaaactgatgtgataaaaatataaactcttggctacatgttttatttagtctactagataatctagaattggaattacttggtcaaagggtataaatatttttgaggtgattcatatattttatgaaacattatagaatatttatactctttgatctattcaatgtaatatacaatatgaaacattcccctgtattctagaatcgcatcgatttatacatgccttcaagtggtatttgtgtcgagtttacgtatccttggcaccatcgagtattgcactggcaaatacatttctattttaattatatattaatatgatagataaaggtagcatcttggtaatttaatattttcatttatatatcatccagtagtatttcacgtgtgtacctgtaatatttgccagttttctgttgagatgatagccttttttacaaaataaatgaacatattttagacatataataaaattttagatgccatattatatattaatatgacttaatatcttatgtaatagtgtagacatatttcttaacgatattaataatttttgtttttttacaaataaaatgttgtatactcatttataatgctactttgagactgtgtggttatataaacaccaaatttttttcttcattatctctgttcttttgtaaacctgtttttcttttactaatttccctttttgcataaaaatgtcgtaatattcattattccaaatccctctcgttatttggtttgtattgtttcatagtgttacttcctcattctttggaccagtttcaaaatcacaatggacagttcaaaaaacatgttaaggattttgattcgaattacattaaaagtataaatcggtttgaggagaactgacatctttacaacattgccccatttcctccagaagtattatctgtccgtcagctgatccatgcttttctttgtatcttcctgtgacctttgatatgtttttttcatagatgccatgttttttgtgtggctagatattttatatttttgttgctattatgaatagtttctttttattgtttttttctggctataattgttatctttctctcttggagatcatcatcaactaagtgcaagatagtgacaggaggtctagtttcacatccctggagtatctgggaatctattgttatagcctctagattctggcactggcctataatttttaccagcctaatctctgctatcccctagctatgtatactgaagctgcagtgaacacctggtccccgcagccatctcattttctccttcctgcacatttgtctctgccttgaccctgacctctgccccaggactgtgtccatgctctgacactcagctgcatgctgccttgctccctcactcgtcccacctgcatgtgactgactcttcctccagacctttgtggcattttgtttgtatctttcttgggagtatttgtcatagttcaccttttatgatttatgattatacctgtcttgcccaaaagtgtgcccgattggaaggcaaattgtaaaagactaagcactgtgacaatgggaaagtaatttagattgctctttgcctcagtctccaaactcgtataggaatactaagttgtgccctgcccactgcataagacttcgtgaaagctctttgagatgtgagaaaggcgaatctaagagatggccaccgggaggtcacttcccctcctaggttgggcagtgcatgaaggcaaggcctggctttcacagtacttcatgcaggtttcatttagctcaacaccctcctctcatagacactcacagttagattgaatcagagggtggccacgcttggcaagcggggaatagcagccaagttgtagtggacttggccgtgtacagagaaggatggattccaggtagtgaaattagaaattacacctcagtcggggacctctggttacctctggcacttacattggtctggaaagaatgtatttatgttggtggggggggaaaagcatatgaaattgagacagtaggtgatccagtggatgttctaagacattccctggaaaacaatgccactgtcttggtgtgtctgatgttctggggaacatttgaaaaacatccgtctctgggccacatctcgagtttctgattccatagtttgagcccaggaacctacgtttttacaaacatccctggtaattcctatcgtaagtttgtgaaccattgcactagaacaggattcttaatagtgacatgcaggccttactgaaaatgatttgttctgtggaatgagaagctaacaaacacacgtacaaacacacaagcacatttcctagaataggcatttctgttctgtagaatttcttcaagtgtcttcttattgatctaccaaacatgaaaatatttccaggatagaaatgctttcccagaaagcaggtataaaggtgtttcattgggaaacatattagagactctacatattagagactaacagttgttatgatgtgaattttttctgtattactacataagtcactctttcttaattgctaaaaatatttatcagtacctgatcacagaattcttacaagacagcatggtctacttacactaggcgcctcacacagcaaattaaataagtatttccgtctaagaatttgcatcctaaacacttgcaggaggataggaaatggattctgtcattataataggatttaattattcctttccatgattttaaatattatgccaaatagatgctcatcgtagtatacaagtgctgaagaatatgagtagattaaaatcactcataatcctgttttctataggcacccataagcattttctcatgtcttctctttctcttacatatgttttttgttatggagttcctacttgataagctgctttgtaaagattttaaaattcagattatatcataggtgttttcatttatcaaaaacttcgttaaatgtccttttaatgggtgcataatagtttattatattggaggtaccatactttgatatgaatatccttgcagtcagaactataaaacatggagaattacattgttagtgcattaagcatttcaactcaacacagttaattgagacatttatatcatgtgtacattttccttataacatgcacttattattccggtgacataaatcttcagaagtaaacagagaaggcaaccgctagacgtagcctgtatgtgcagtagagggcagaggaagaccagcagtgtaatcacctggaagtcatcacccaaattaccttatttcattctgcagtgatgacacaatcaaagctaatgagcaattttacttttcacttatttcgggttttgcagcatttggagttgctgacgctcattggcttcctggcatcttcttttttgctttcctcccaccgttcttccctgtttcctccttcgttcctctcagcctcttctccgcgttccggttttcccacttgtcccttgttcttatgcaatacttgatcctcttctcactctaaactgtctcctggctgatttcctcttgctcccatgtctttaacttcctcctagagatgatgtcctgccaacttaaatcttattgccactctctccactgtgagactcccctaagctcccaccactcactgtggtccttgttcagatccatgctccactgtgtgatcttggtcatcctccactccttggatcccccaatcacgtgatctctgcttgtacacattgcaccgtatatgtttgctgtgccctgacgtccaagggacacgttgcatatgtggagagcagtggcaaggaatgattgattgcttgattgaccagtaactgattggatcactaactgataggcatgaaaactcctccctcactaattcctatataatcctcatctgagcccaggatttggtgatggtgctctgtaatatgtagtccaactttctctttctcacagagcttacatttctctgtgtttgtgtgtgtgtgtgtgtgtgtgtgtgtgttgttacctacatttaaggttactcaaaaagcagcaataattgtatcttatgtaattattgtctaaatttctaatcctttggtgccgatttctgaaacaatgttaacaaaagtaatcaaaggatgaaataatatatatttaattatttttgagttgtgtcagttcttatattaaatagtgtattgaatttagggactaaaatgtaattataacaaagcaattcactctaagaacatttgattgtttataatactgtagggtgtctaacagtagataggagacctctgatatttaccatagaagttcctttaaaaaaaaaaactcataagtaatacggtttatggaaaaattcatcttgtttatggaatggtagtgcgaaatagaacttgtattttagaaatgctttaaagatcttgaatgagatatactctctcaggttcttaaacataagaatcagaatatgaaaggcatgttttattttctagattttccttctctcgccatttgactaattcttacagtaaaagtaggggaagtgaatgaagtgaacatcaatgatcccatgctaggtttgtttatcttacttttggaaaacaatgataatgattctgtgtagggctgtggtttttaaattgcttgtctgctaattataagaaaagccaagatattgaaatttgtgtagtgctaattactcatccctttctttcccgctgcaatttacagtgtgtcttcagggtgtcagtcactgatttggagcttctgcctctgcttcttctcagcaattaggtctcatcttcaactaatggaattgagtgacgtttagctagtaatatggggaatctgtcttcagctctgcttcattagaagttggtgcgaggccttgaaaaaggtttcctgtttgttgctaagacaatgtgatttgaacttactctaatacccctttttttgagtcatttttgtctcactgtcttcttactgcttgccccacatgattctttgaccatcttcatccccaaatctgaattttgccttaagcaagatgtgcaaaaagtacttggttttacttctaaagctgatgtggtttataacttactcatttcctctccccacttcactcctacagtaggttttgctgcttttattgttgtcaccagtatttctatgtggtaatgatccttgaatcttattttgctgatcatcaatctgtggaagagaaagactgttaaaagaggcctcttaactcgcactttcagaaagatggaattagatggacttttccctttttgtcctgagtacagctaaaaactgtgaacattatatgaaaagcataggaagatactgaacagtggagagaagaaggcagacagactgaggaccttgagacctgatgaatggcacagtgctggcatctctgagctttccgtttctctcatttagcttgcactgggtgttgagaagctaacagtccagttgccagtgggcacagacaagaaaagcacccccaaaccctccccttcctcccaaaggaccacaaaggaggcagcttagaatgacagaaaacttttggacaataaccactctgctatagccaaatactaccgaagaaaactgtggccatattcacaaacccccaagcaaaggctgagcagggagcttagactttcagcgtgacccccatcagaatggtaagaaagaaggatgggtgtggggccaaggcttgtgtctcctcggtgtggtcacgcgttccctctcacggtattggagagagcacctgaggcgcctgaacttccaccttacctggtgctgtcagggtgtcccttgtcctccccactggggtgatatcagaagaggcctagtggagaatcaggattttcccatcttctcagtggtgacaagggccctcctcactcagagcgtcagtggaggcgtataaggagcagtcacagaaccctctgcacctctatctcagctcaggctgctatagtaaaacaccacaaatactggggcttagacagcggacgtctatttcctcacagttctggaggctaaaagttcaaggtcaaggtgctggccagctcatttcttggtgagggctttcttcctggcttgtaaacaaccaccttctcgctgtgtcctcacatggcaggtagagagagagaacaaactctctggtgtctcttcttataagggaaccagtttcatcataagtgccctgtgctcataacctcatctaaccctaattagttcccaaatgtcctatctctaaatgccatctcattagagtttaaggcttcaaaatacgaatcagttggggaggacacaaaggatcagtctataataacctcctacccaggagagacatcagcagagaggcccaggggacgctggagctttcacccaaacctgggaggaacaaggaatcaacttcccactcccaggtgtcaagagaggccaagtggggctcctggatgtccacctgccacctggcagaaatgaagggcggcacttctcttggattcctactagtgcagtgtcagaagaggcctgataaaatagaaggctaaagtaacatacacaatctcataacatgatatcccctaatgtccaggtttctagtgaaaatcattgatcataacaagaaccaagaatatctcaacttgaatgaggaaagacaagaaacacccacaacaagatgatacagatgttagagatgtccgaccagcattttaaagccagtcataaaaatgcaatcaatgaggaattacaaacatgctggaaatagaaagaaaaaagaggccatttcatcaaagcaatcgaaagtctcagcaaagaaatagaagagataatagagtactgaatggaaattttagaactagaaaatttaataaattcaattaatcttgatgatgtactcaacagcagaatggagaggacagggaaaagaatccgtgaacttgaagataaaaaaaatagaaaatacttgatctgaacaacagagaaaacagactaaacaaacaaacctcagagcctcagagatttctgggactacaataaaagatttcatgtttgtatagtcagtatccaagaagaagagaaagagggtagagttgaagaattattcaaagaaataatggttaaagatttcctgaatatggcattttaaaatatggcaaattcgttgaagaattgttcaaagaaataatggttaaagatttcctgaatatggcattttaaaacacataacctttcaagaagccgagagaatcccaagatcaaagaaatgcacatcaagaaacatagtagttaaacttctagaactaaggacaaagaaaaaaaattctaaatgcagccagagaaaacagtacctgacatatagggggaaacaatttgaatgtcatcagatgatctctcatcagaaattgtagtgaccacaagaaggtggcaaacatttttcacttactgaaagacaagaactgtcaactgctaattttaaagctggtgaaactatccttcaggaatgaaggggaaattcagacattctcaaatgaagggaaaactaaaggaatgtgtttctataatacctacccttaaagaacaggtaaaggaagcactccataaacgattttttatttttattaagatgagagttatcttgggacatcaagaaagaaaaaagaacagaaaaagcagaaatatagataaatagacttttcttttccttttgagttgtctaaattatgtttgttggttgatgtaaaaagtataacattgtcaaatgtagttcacagtgatatagaggagatgtttatgacagtcatacttggtgtaggataagggacttaaagaatggtaaggtttttatacttaaactggtaaacgttgatactaacacaccataagccttgtggatataatgcaataattaaagcaaccactaaaaagctatccagagagacacaaaaatgccataggtatgtcaaaatagaatttcaataaaatgttcaagtaacagaaaagcaaaaaagaaatcagggaaacaagaaaacagagaacacccacaacaaacaaacaaaaatggtgaacttaagccccagaatgcccataattatagtaagtgtaaatggtttaaatacaccaatgaaaatgtagagacaatagagaaaagtcgattcatctatacttttgcactttttgttctttcttctttccttccagatgaccccaaatacctcccaccttttttccccttatttctatttttttggtgtgcttccgtcagctattccttaaaggtgggtattataggaacccattctcttagtttttcttcactgataggagattggtagagtaaagaaaaaaaatgtggagagcggacatcttgtggctgtgtcgtgcgcgtgagccccatagggctggggaggaaccagttgccgcgcagggaggaggctgaggctatctacgtagaaaattccaaggaatctatttaaaaaaaactcagaataagttcagtaagatcaacatacaaaaatcaatcacatttctatacagtagcagtaagcgtggaaattgacagagaatacaatactgtttaaaattgctttaaaaaacacttaggtataaatccaacagaacatatacagcacttgatgttgaaaactacaaaataccgatgacagaaatcaaagtgctaaatttgtggccaacatgccgtgttcaacatgtccatgtctataaaaagtggactatgtgtctataaaaagtgaatttttcccaaattgatgtataggtttaatgtaattcatatcaaaatcgtagcaagactttgtgtaggtacagaaaagattgttctagttgggagtggtagcacgtgcctgtagtcccagctacttgggaccgtggggcaggtggattgcttgattccaggatttggggttgtagtgagctatgatcgtgctacagtgccctagcttgggtgatagagcgagaccctgtctcaaaaaaacccaaaaatataaaagattattctaaaatttatgtggttaagcaaaggagctggaataggtgaacagttttggaaaagacggataaggtacaaaggatcactctattcaatctgaattcttacaatataggtaatgtaataaaaactgtgatattgttgtagggatagacacatgaatcaatggaacagaatggggaacatagaaataggcccacataagtacagccaagagatttttgacaaaagcataaaagcaattcaatggaggaagaatagtcttttcaacaaatgctgctagagtggttggacgtgcataagcaaaaaaaaaaaaaaaaaaaaagaaaaaagaaaaattgtatcttgacctacaccctaatctttatataaaaatttacttaaagtgtgttggattaagtgtgaaatgtaaaactgttaaactttcagaagaataaacctctggggtttagaacttagtgaagtgttcttagacatgacaccagagacacagtccataaatgtaaaaattcaataagttggaattcattaaaatttaaaacatctgctctgcaaggggatgaaaagacaaaccatagactgtaataaactatttctaagctacatatttgagaaagtggccatatttggaatacataaagatttctcaaaattctacaattaaaaaaatctaatgctaaaatgggcaaaagacgagacattttactattgtacgttttcttgtgggagcaaagtaaatctttttaaaaagcaactgtgtctttttcaactcacttcttggaagtgatgatggaagtgtgtattcgtggctcctgcagaggttttagctggactttccatactggacatgaataagcacccctctccccctccacattagggccggatagcattcaccactctcacctgcttagtcttctgccccaaactgcttcattcatacctgcttctggaacattttctcgtacactgactccagcacagaggctgttctttctaagttctccctgaattagcagtgatgagatgcctcatgacccgagaaacctggccttggctgttccccatgttggactagtattggagatcacatagtttattgtttcacttgtcattgactagaaaataaattagaaagatggttcaagttcagcatttttactcatggtactccttgacttctgcctgttttgcaaaagagggtctgtagatgacaaaaacatgaaaaagacattcagtggaaatgcagattgaaaccaaaataagagatcactagctattagaacagctaaaataaaaagtagtgacagtaccaaatactcaggaagatgcaaagaaattggatgtttcatgcgttgctggtggagatataaattggtgcatctagaaaatattggaaaatagtagtttctttaaaaagtaaatgcgagactctgtctcaaaaaaaaaaaaaaaaaaaaatgtatgccgacgatacgacttagttctcctgaacgtttgtcccagagaaatgaaaacctgtgtctacacaaaatatgcttctggacattctagaagctttcattgtaatggccacaaattggaaataacccacgtatttttcaatgagtgaataattttacaaattatggtgcattcatgtcatagaacactactctgcatcataaaggagtgagccgttaataatgtaacacttgggtgaatgagtctgaggggaattacactgaaaaaaagcctgacttgaaaggtcacatgttgtatgattacatttatgtaacattctcaaaatgagaaaattatatagttgaactaactagtggatgccaggttgggatgaatgggaggattagatgtgtctattagagtagcaagagggaggtgtgtatggtgatggcagttttgtggctggactgtagtggtggtgaagtcagctacacatgtgataaagtgacagagctatactcacacattgcactaatttcaatttcctgatttttcaatgcattgtatttccttaagcagtatccattaagagaatcagggtaaagggcgcctgattttctctgttctatttttccaatttcctatgaatctataattatttcaaagtaaaatactgtttttttccttgaaaaaggagacttctccaatgtccttcaaaaatatctgtcgttggcttcccaagacgtgtgaatttgttgttgttttattgtgtttttgttttgtgtttgttggcatcaaccaatattttctttattttatttctgcacattttacttttgtttttcatctttttatttcaataacttttggagtacaaatggcttttggttacatggatgaattgtatggtggtgaagtctgagattttagtgtacccatcacctgagtattgtacattgcacccagtttgtcgttttttcttcctcccctttctgagttcccatagtccattatattgcactgtatgcctttgcgtatccacagctttgcttccacttataagtgagaacatatggtatttagttttctattcctgagttacttcacttggaataatggccttcagctccattcaagtttccgccaaagacgttattttgttcttttttttatggatgagtagtattctatggtgtatatataccattttttctttatctactcattgtttgatgccacattttctttatccacgcattgttcgatgggcacttaggatgaggatccatgccaatatcgattttttttttttttactttttaataatggccattcttgcaggagtaaggtggcatctcactgtagttttaatttgcatttccctgatgattagtgatgttaagtatgtctcttgtatatcttcttttgagaaatgtctatttatgtcctttgtccactgtttgatgatgatatttgtggttttcttactgattagtttgagttccttgtgttttctggatatcagtgctttgctggattcatagtttgcaaatactttcccccattctgtaggttgtctgtttactcttgatgattgtttcttttgctgtacagaagctttttagtttaattagatcccatttatttattttcatttttgttgcatttgcttttgaggtctcagtcatgaattcttttcctaggccaatgtccaaaagagtttatcctaggatatctaatagagttttatggtttcaggtcttagatttaagtctttcaccatcttgagttgatttttgaataaggtaagagacagggattcagtttcattcttctacatgtggctagccacttttctcaataccatttattaaatagagtatgctttccccaatttatgtttttgcgtgctttgtcaaagatcagttgattttaagtatttggctttatttctaggctctctactctgtttcattggtctatgtgtctacttttgtatcagtaccatgctgttttggtaactgtagttttgtagtataatttgaagtctggcaatgtgatgcttccagatttgttctttttgcttaggattgctttgggtcttagggctctgttttgtatccatatgaattttagtatttttttttctaattccgttaaaaatgatataggtattttgataggaattgcatgcaatctgtagattgttttggatagtatggtcattttcatgatactgattctttcaatccatgagcatgggatgtgtttccatttatttgtcatctatgatttttttcagcagtggtttgtagttctctgaagagatttttcacctgcttggttaagtatattcctagtgattttattttattttattttattttattttattttattttattttattttattttattttattttattttttattttatttttgcagcttttgtaaaagggattgagttcatgatttgagtctcagtttggtggttgttggcatgtagcaatgctactgattggtatacattgatttttgtgaactgaaactttactaaattcatttatcgaatcaagtagtcctttagaggagtctttagggttttctagttatgtgaccatggcattggcagacagcaataatttgactctctcttttccaatttgggtgccctttaattttttttttatcttgcctgattcctctggctaggacttccagtactgtgttgaatagaagtggtgaaagtggtcatccttgacctatttcagttctcagggagaatacttgcagctttgtgccattcatgatgcaactgtcatgatgttggatgtgggtttgccacagatggcttttattttgaggtaagtcccatctatgcctagtttgttgagggtttttataataaagggatgctagattttatcgaatgtcttttctgcatctattgaaatgattatatggtttttgtttttaattctttttatgtgatatatcacatttattgattcatgtatgttaaacctccctgcatttctggaatgaaacccacttgagcatggttattatattttgatgtgctgttggattcaattagttcatattttgttgaggatttttgcatctatattcatcaaggatattggtctgtagttttattttttgttgctgttatgtctttcctggcttggtaccagggtgatactggcttcacagatgagttagggaggattccctctttctcagtcttttggaatagtttcagtaggattggcaccaattctttgaatgtctagtagaattcagctgtaaatccatctggtcctgggcttttttgttggcatttttcttttttatggagtcttgctctgtcacccaggctggagtgcagtggcacgatctcagctcactacaagctccgcctcctgggttcacaccattctcctgcctcggcctcccaaatagctgggactacaggtgcccgccaccacacccggctaatttttttgtatttttagtagagatggggtttcaccatgttagccaggatggttgcgatctcctgacctcgtgatccacccactttggcctcccaaagtgctgggattataggcgtgagccactgtgctcggccagcaacttttttttaaattactcattcagtctcactgcttgttactggtctgtttagagtttctgtttcttcttgatttaatcaaggagggttatatgtttccaggaatttattcatttcctccagattttctaatttgtgtgcacaaaggtgttcatagtagtatcaaatgatcttttgtatttctgtgctgtcagttgtaatgtctctagttttattactaattgagtttatttgaatcttttcttctcttggttagtctagctaatggtctatcaactttgtcttttcaaagaacaagatttttgtttcattgatattttgtttttgttttttgtttcaattttatttcattttgctctggatctttgttatttattttcttctgctagctttgggtttagtttgttcttgtttctctagttccttgagatatgacattagattgtcaatttatgatctttcagaattttttgtggaggcactttatgctataaacttttctcttagcattgcttttgctgtatccaagaagttttgataacttgtgtcactgttatttatttcaaagaatttttaaatttccatcttgatttcattgtcaattcaaaaatcattccaggagcaggttgtttaatttacatgtgtttgtagttttcaaggttccttttgtagttcatttctcattttattctattctgatcagagaaaatacttgaagtgattttgatttttaaaacatttatcgagacttgttttgtaatccattatacggtctatcttggagactgttccatatgctgatgagaagaatgtgtatctgcagttcttgggtagaatgttctgtaaatatctgttaggtccatttgttctacaggagtttaagtccattgtttgttcgttgactttctctcttgattgtctgtctggtgctgtcagtggggagctgaaggccccccctattatcgtgtttctgtttatctcatctcttaggtctaatagtaaatgtttcatgaatctgtgagctctagtgttaaatgcatagaaacttaggattgtaattcttcttgttggattcatcctcttatcattacataatgaccttttgtgtctctttttttctttactgttgttgctttaaagtctgttttatgtgatataagaatagctacttctgctcacttttgatttctatttgcatggaatatctttttccatccccttaccttgagtttttatgaatcctcatgtattagtctcattgctataaagaaatacctgagactgagtaatttatttttttttaaaaagaggtttagatagctcatggtactgtaggttgtacaggaagcgtgatgctgctcagcttctggggaggcctcaggaaacttacagtcatggcagaaggcaaagaggagcaggcacatcttacatgacaggaacaggagcaagagagaatgagaggggagatgccacacactttaaaatgaccagatctcacgagaactcactcactatcacaaggacagtaccaggaggggtggcactaaaccattcatgagaaacccacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccattcaacattggaaattacagtttgaaacgagatttgggcaggggcacatatccaaactctattaccttacatgtcaagtgagtctcttgaagacatcagatatttggtttgtattttctatctattctgcccatgtgtatcttttaagtggagcatttaggccatttacattcagtgttaatatttaagtgaagcacttaggccatttacatttaatgttaatactgcattcatgatactcttccagccatcatgttaattgttgcctagatactttattttatttattgcattattgttttataggccctgtggctattatgctttcaagaagttctattatggtgcataacaaccttttgtttcagaattcagaactccttttagcatttcttgtagggctggcctggtagtgacaaattctctcagcatttatttgtctgaaaattactttatttctccttcaattatgaaacttagttctgctggatacaaaattcttggctgacagttattctgtttaaggagcctcaagataggaccccacatcctttgggcttgtaaggtttctcctgagaagtctgctgatagaagtcaggaatggtttccctccatccatgctggagactgggcatgcatgcaaggcccttccttctgctgctcctacttaatattccccacccctccctgtatcaggttcagcactaggtagggttaaggctttctctgtggactggattgccaggttccctggaggcagtccgtcccactgtcatactcacagttcttcacctggctcatggtgtaggctgcagcctgctgcttctttcaaagggtctgtggtttctttccatttttctgttaaattccttcattgtttcttggaagaaagttaatggtgtgtctctgcagactattttttctttccaagggggagacgcatgctaacactgcctccaatccaccatattgaaaaaaagaagttttcctatttttaaagtaaaatccttttcttgaaattgggcttttgaaacatttgcctaggtactttgcaagatgaaccaaacttctaatatcaaagggaacttggcccaccaaagggtagaagctgtaggctctctcctcctgctgtttgtcatcaaggcccacacaggggtcctggccccagctgcaagatgggctttgtgtgagctcacaggagcaaagcacgtgccaggtgccccgagacttaaatgttctctctgcttttatatcttttcatcatttcatagtttctgaaattatttgacatattacttgactataaaggaaaaaaaatcagagattttattaaaactctgtaaacattcctaattaaacctcacatgttgttcacaaaccttttatgttttaagctgcttcaggacagagaattgattctcctctcatttttcactgacagatctggtggtacttagagccagtaacatgcagcagttaattatgctgctgtcccacatgtgtacattttgttttcttgcctgtatttgttataaagagggttcatgttacattcctctgcaccctccagaatgattaggtgggcgtgagatcctcacatactgaacacacacttagtaactttcttgttgactggttattctgttgtttcatgttattttaatgagactgggaaaaaagccattgctcaaatctggttattctttattaaagttctcatattggaattattaaggactaatgtcattagggacatttctacttttgatatagaaacaagctgcttagggaaaaatctcctgttttcatgcttgacagtgtagtttctcgtagttaaaacaagtctttatgtactgttttatctcctgtgctaaaacagaacggtgaaatctaaggcaaacattgtgtgtgtgcttcgacactctcgtaaattactcttgccattaatttaaccacagttgtgttatcacttgacctaaaggggctcctggatgattgggaaaccagcagagaggctaatgggccaacaatcttggcagccaacctccgtgtatgtcttggaaaattccttcaggatgtttgctttggcatttgattgttcctatcttcagattaccttattttatagtatattgaatgttgcatcattaacaaatacctggttgatatctttattactgtggcttcaggcagtaatacaaagatttttctctaaaatacaaagtgtatttgaaagcttttctttacatgtatatcagtttcaaactttacaattaaattttattcccaggaaactctcaggatgttcttttgtgtattcataaggtataatttgatggcaacttatattatttttcagaaaggaaaatagtttcgtatccaaaagtttgaattgtcttatttaagaaagttgacacactttaatcacaggaaacagtatgatttgacttttctaaaccacataaaagtatttctaaatatttttgcagatctcttcttctctttaaagtgagaataatcttctttaattttggagactgtgctaaccattatctttgctattaaggattagttttgtaactaaatatgtgttgagtcctgggctcacacttcagggatacatcaggagacaagtaaggcctctgacctcgtaaaatttacctgggagagacaggtagttccaagtaaacaaatgaataaacaagatgatgatagatggctgtgaattctatgaaggaaacaatgactcaggtcatggaggtgatagtttgctttggtgggtgatcgggaaggctgctctagggaggtgacatttgcatagcttcctaagtataagaaggagccagagatgctgctggtaccagggctcagagcatttcaggccatggagttgacatgttcaaagagcccaaagcagaaaagctgtttggtcaagaaacaggaagaaaatgactgtggctgtagtatcataagccaggcaaagggtcaaggcagggtgggagagttaggcaggaaccagatcctgcaggccctggaggccattgaggttcttcccattctgagtacagtggggagcttctgtatgcctggaagctgggggcgttgtgatcttttgatttgactcctgggagaccagggaggagccctgccatggtagacttccaggggaaacatctctgtggctgttttcctgtgcgggcaagttactttgtctaaagcccagtttccacattagtgaacaagattaatgatggcatctacacagtagggttggtgtgacagttccataagaacatgcatgtgaaacggttaatccagtgcttggagaaaagcaaatgctctacagcagaggtccgcaacccttgggtaggaaccaggccagtccatggcctgttaggaaccaggctgcacagcaggaggcgcagggtgggcaagtgagcgaagtctcatctgtatttacagccattccccatcacttgcattcctgcctgagccccacctcctgtcagatcagtggcagcatatgattctcataggaccgtgaaccttattgtgaactgtgcgtgtgagggtcctaggttgcacgctacttatgagaatctaatgcctgatgatctgtcactgtctcccatcacccccagatgggactgtctagttgtaagaaaacaagttcagagcttccactgattctgcgttatggtgagttgtataacgatttcattatgtattacagtgtaataataatagaattaaagtacacaataaatgtaatgcacttgaatcattccaaaaccatcccccaaccctctggtctgtggataaattgtttttcatgaaactggtccctggtgccaagaaggttggggactgctgctctacagcattataacgatattgtcatgttgttttaaagatggataggacatttcactgccttcctgaagcgcatggcagtgggcatatgaacagacatttactgggcagtagttaccttgttagagaaatgggtacaagagtatacctgttcacctaggaaagaagttcattctgaggaaagggtcagaaaagtcttcctaaaggagcagagtctaaatgtggctaaataaacaaggaatggccctgcgacttggcccaggtgcccccacaatatagaccccttggaccttcagtggtgccattggattctctcctttggttagtgcactgttccctgaaagcttctgtgagctgcaaacccatatgcctgacacccaggaatgctgattgctgttggccacaagcttgtcttaaggggatgggcaccaaggcgtgcccatgtggctggggcatggcagggtgccaggaggcaggtgctgcgtccctggagaagcagatcttgcacagcggggagcaggctgaaggcaccaggaaccctctgccagcacacccctgagataagcacttccttcaaagctgagtccggctgctcagcgaattgatggatgatgaagacattgtcttcctttgttaggataagaaggataatgatctttctccttccaagtcgtctgggagctcaggctctgtgttgtgataaagtacaattggggttgtttgtctttccatgcttacagaaatcctattcctcaagaaaagaaagaaagagcctacaaagaacttaaaactaagtaaggacttcaaaaaagaaaggtggagagaggggaaaagatgactgctacacattttccctttgcttcccacgggaatggcttcattcttgccttgagtgtcttagatatgtctctcccccacccgcagcactggcttttctgtcttttaccattgaattaggcctggtctagacttcagtatttatacctgagagtacagaaaagaggcttttcaagaatacgtcagttctgttagaataagatcccatccgtcatcagatacctttctacagctttctgtcacagtatttgatcactgatcatagaacctggactagagatttcatgtggagaatgtactcccttcaaaaggaaaaccattcaacaatttaatatttaattgattaaatacatgtgatttgctaatgttaaggtattatagtcacagcccctcacttgttgacaagtcctatatcaagtaatcatagtgattaaaaacaaaaccgagagtcaggaatcagcaaatcaggctttccactgccaaaatgaacattatattaattcatgactttatttaaaagagagagcacctcagaccctaattcaaagactgtttcatctcagcccacaaacatcgaaatatcagatgagaaacattttgagaggcaggtgtgcagacggcagcaagtcgtgagccggctgcctgacagcaaaggaggaagcgtttaaagtatggagccaggaattcaaaacaacaacacgttgacgccatggtgcacatccagggcaacagaaagagctctggacttagactcagagggacgggaaaaactcagaggctgcagatagaccaggaggtagaggccttgatcactccttgtgtagccagacccgttgcttaaaatctctgaacttccttattgtaaaatatgaaggaaaatcattactattcttagaattaaatatttgtgaaaggagctttagaatgatagaagtaccatagggatgttattatcttttttactctcttttcaacctgtcaattacctgtttaaatatgaactagttattcgcccttccagagtctcagtttcctcttaaattaagaataataagtttatcccatttgctcatttcacatcagtcctttaagtgctttgcattttgttacatcttatgtaagtggtgatattagcattactacattgtaacacagtacacaacatctgaaaatggtcctgaggccttcaaagtttaaatgtcgtttaatacactttattgaagcaggtacagaactgctgtgtaattaatttcaagacacttattttctctcaaaagtgcttctaaaacaagtttccatgcttgaagcgttgagtgtcaagtatctgggagatttgcttttgtaggacggttcatttcccacttgtgccagaatgagtcattttgtgtgtaagtgtcaagcttggagaggttctaattaagtgcaaattacaatgaaattaataaatgacaccaatttttagattttaaaatgtgctttgagagaatgcaatgtgggcttagattgatggtaattctcatattttaagttgtgattcaatattatgtagcattaaaactcaattaagtaaaaaataaatgaagaatcaagtagagagaatactcatctctcagatgcctcagcttctccaatgatggcttaaaatctgttaaatgctaaggttgtaattgtccttattgttcactatattccaaaataattgcacatataattagcttatttagtgagagatactaaatcaccctgttcacaaatatactagatcgtcataaattgtacaaatgtaattgtaaatttaaggttttattttactttttgcagatgagctgcagactatatataaattcatgtatgtatccacttaccagaaattttattaaatcaaaatatatttgacccagcattttccgatccgtttacagtgggagaaggtaggctacgtaggttcttccctcctcaggtggcactagtcaagactgacagagccaccagcaactgatagcccaaagatatcctctcagcctaccgaaccagacacccctcaccttctacctggtgatgcagggaagcccagggaagtgcgttctgtcccacaggaggcaatagcagggatagagaaggatccccagaccctacagaacaaaggagaccaggacagctctgaaaaacacattatcattggaactacagcccaaaaaagtaggcaaagtcctataccctaaacccatcaggcaactgccatctaaaataaaagatttaaataggacaaggagtcttaacataatatcgaaaacgtccacagagaatggaaaattactgaacatacaaagaacaaggaaaaatcacaacttgaatgagaagacacaatcaactgaggccaaaattgaagtgagtcagctgttgcaattaccagacaaggattttaaagcagccatcataaaagggcgtcagcagcaaactattcattctccttgaacaaatgaagaaatagaaaaatctcagcaaagaagaagaaattatttaaaaagtgaaagtgagtgaattgaaacattccataaccagaattaaaaactagcaggattagctcagtaataaagtggagaagacaaagatagatcggtgaatatgaggatagatcaatagaatttgctcagtctgaccaacaatgaaaaaggtagacaaaaaaaaaaaaaaaatgaacagaggctcctgtgaggctgtaaccaaagatctaactttaattttattggagttctagtaggagatgagaaagaaaattgggactgaaaaagcattcaaagaaataataggtgaaagctttctaaattgggggaaaaaaaaaactccacaagcctacagattcaagaagctgaatgaatcacaatagaccctaagaaatcaatttgaagacacttaaacttctgtgttgaaaataagtaatttctgaaagctaaggaaaaattagaactctgaaaaaaatctgtcaaccatgaattctgtatttggcaaaaatatcattcaagtatgaggggaggccacgtgttatcacgtgtaatatcagacctgtaatcccaccactttgagggacattgatgagggaggattgcttgaggccaggaatttgaggccagcctgggcaaggtagtgagaccccattgctacaaacaaatcaaaaaattagccaggcgtggtgcacacccctgtagtcccagctactcaggaggctgaggtggagaactgcttgagcccaggaggtcagtgctgcagtgagctattacggcgccattgcacttcagcctgggtgacaaagtgagaccctgtctcaccaaaaaaaaagaaaaaaaaaaaagaaaaaggaaaaatcaaactaaggaaaaatcagataatgtgttgctataatagttaaatgaggtcctccaaacagaaagaagaaaatgatcagagaagaaggcttgcaactacagaaaagaaagaagaacaaataagtggataataggggtaaataaaatacactacttttcacttcatgagtttcctaaattatatttgaagtttgaagaaaaaaaatttaattccatctcaagcagtgttaaatgtatgtagcagaaatacttaagactattagattttaaaagtggggaagggaaaaagatttcagtccttcctttgaaggagtggaatgaggatacaagtaggctgtgataggttatagatgcctcttataacaattagaggaactaattgaccgaaatagaccatatcctggttcataaaatctcaatgaattttaaagaatagaaatgcatagtatgttctgtaaaaataaaggaatcaaactagaaattaacagagagataacaggaaaactttaaacatgtggatattaaacaacttctaaataatccatgtgtcaaagaaagtatcttaaagggaataaaggaaacactgaactgaatgaaaaatcaaaatgcaaaacaccataatttggcagatgcaactaagggcatgctgagaggaaaatttatagcattaaatgtgtatattagaaagagggaagtctcaaatcaataatttaagctcccacctaagaacctagaaaaagcagataataagagaaaagacacaaatcactaatgttgtaaatgaaatgacctatcactatggttactgtagcctttaaaagaatgataggaaaatactacagcaggtttatgcccataaagttgaaaacttagattagctggaccaaatgctcaaaaactacaaagtgccaaaaactcaacctatagatatataacctgaatagtcttaaagcccttagagaaacttaatttgcagttaaaccctccccacttgatatcctggcagagatcatttgacttgagaaatttgccacacatttaaagaagaatttaaatcagttttacagggttttgtttattaaattaagagtaggaaacacttcccaattcatgttgtgaggccagtattattctgatacctggaacagccaaagacagcatttaaaaaaaaaaaaaactgtaaacctttatgtctcatgaatataggtgcaaaaattctcaacacagtaatggcaaactgaatccagcaaagtacaggaagaattagacaccgtaaccaagtgggtgttattccaggcatgcaaggctggcttcatatttgaaaatcaactcatgtaagtcatactaacagcagtccagagaagaaactttatgagcatatccattgacacagaaaaagcgtttgataaaatccaacactcagctggttgcggtggctcatccctgtgatcccagcactttcaaaggccgagatgggtggaatcacttgggctcagaagttggagaccagcctgggtgacatggtgaaaccctgtctcaaaaaaataataaaaataataaattggccagctgtggtgccaggtgcctgtagttccagatacatggtgggcctaaggtgggaggatcgcttgagccccggaggttgaggcccggaggttgaggctgcagtgagccatgtttgcaccactgcactccagcctgggtgacaaagcaaaactgtatctcaataaataaataaataaataaataaataaataaataaataaataaataaataaataaataaataaatatctaacactcattcatgctaaaaattctcagcaatctagttatagggagtagcttcatcaacttcgtaaagagtatgtacagaaacttacaactaatacacttagtggtgagaaggtgaatgctttttccccaaagttgggaaccaggcaagaatgaccgctctcccactcttaacagagtacctaaccagtacaataaggtaggaaaaaaaaaggcatccaagtttgaaaggaggaataaaagtgttcttatttgtggatgacattattgtcttcattgaaaatccaaaggaatttacaaaaaagtcccaagctaataagtgattccagcaagcttgcagtatacaaaatcaacacataaaaatccatcacgtttctatataataacgcgtggaaaccaaattaaaaatacaataatacaatgccatttataattgttccttgcttttcatcctaatgcctaagtcctgggaacaaatcttgtttgtagatatacccaaatctatattataggtatacccaagtctgtatttcatttggggataaatctaacaagaatagaaactattttgaaatttacaaaatgctgagaaatggaagaaatcaaagacctaaaaaatcagagagactttggggatcagaaaacccagaaaggttttttttttttttttttaaatataggtactagacctagacagtctcattctgaaatgtagatggcatagcacaggacctataataactaaaacaactctgaaaaagaagaaaaaagtaggaggaatcattgtttccagtgttaacgcttactgtatcctgacagtaatcgtgactgtgtggtactggcaaaggaaaagagacataggtcagtaggacaagacagagaacccagaaacagacccacacgaatatgcccaactaatttttgacaaaggtgcagaagtgactcagtgaagaaaaggtggcctttacaataattgtagctggagcacttggacatttaggacaaaagtgggtggaaccttgacctaaagttcatatttcattaaaaagaaaactcaaaaaagtatcacataaaataaaaactgtaaaactttaaaacttttaggagtccgggtgtggtggctcacgcctgtaatcccagcagtctgggaggctgaggtgggtggatcatgaggtgaagagattgagaccatcctggccaacatggtgaaaccccgtctctactaaaactacaaaaattagctgggtgtggtggtgcgtgcctgaagtccaagctactcaggagactgaggcaagagaattgcttgaacccgggaggcggaagttgcagtgagccgagatcgtgccactgcaccccagtctggtgacagaacaagactccatctcttaaaaaaaaaaaaagaaagaaaaggaaaactcagagtatctttgggatctaagactaagagaagagtttttaaatttgatgataccaaaggtacgatttacaaaaataaaatcttatcacaattaaaaacttttatgaatgaccttattaagagtataaaaaccagccactcgggaggctgagggaggggaattgcttgaaccagagaggtggaggttgcattgaggcaagattgtgccattgcactccagcctgggcgacagagcgagactctgtgtcaaaaaacaacaacaaaaaaagtataaaaacaaaaactgcagacatggaaaaaaaatttgtaaaccacgtacctgatgaagaactagaatatactagaatatattgaatatatagactactcttagaactcaacattaaaaacctatcagaaaatgtgcaaaatacatacacagatatttcaccaaagaggatatacaaatggcaaacaaacatgtataaagatattcaactttactagccaccaggaaaatataaactgaaaccacaaggagatatcactacaaacccatcagaatggataaaataaaaaagttgatagcaccagataatggcgtgagaatgcagagaaactggatcactcatatattgttagtgggaatgtaacctggtacagccactctagaaaatagggagttgagaatttcttcccaacttactctgtgacccatgggtgcttactttatgatcctttgcaagctactgcattcttgggcatatctcagagaatgaaaactacgttcacacaaaaacctgtacatgagtgtttctagcaccattgtttgtaatagcccaaacctaggaaaagttcaaatatcttgcaatagacaaatatttaaaacacagtgtagtacttccattccatcacacatcgctcataataagaagtgatgggcttctgatacacacaactgggatagacctcaagagagttatattgagtgagaaaagccaatctcaaatggtcacagaccgcatgagtccatttagattccatttatttaagatccctcaagttacacagttacagcaatggagaagagatcttttgttgccaggagttaggctttgggatggagagcaagggcatgggtggggcttaaaaagggagctggagggagcttggaggtgatggaactgttccctctcttggttgtggtggtagttacataaagctacgcgtgtgataaaattgcatagagtgtatttacacccatccatgagtgcaggcactgctggtgtcatctgaatactctctatgaattctcccaacatcagtttcctggttttgatgttgtttggtaaactgtagttactcagcacgatgttggcactggggcaggttgggtgaaggatgaatgggtttcactgtacatttctttgaactcctcgtaaatctaattatttcaaaataaaatgaattaaagacaatatgaatgagagaacatcaaataataaggctttcacagtacagcgtaggcttctaaagtttgggaggagggccttgagatgatttggtaacacctctgtgggtgcacccttctgacgcaaatgaccctctgttgtctcttctgctctaaccaggcatcagctatgtgggtgtctggtgtttccaaaggagggtaggatgagatcagagagtgcattgtgtgctcactgaggaagggggaggaataatgatctgttcccaggattaagaaagaggaagaggagatacaggaccataagaaaagagaacccagagctgagagcttgtaggaatgtctctgctccattctactagggcttagaccggttggcataacaacttcatgaactgtcggccatccttaagctctcctttaggtaccaattatctcctgattttctcttcattattaacagtaaattattttcctttcctctttcctttcctttcctttctgacaaagtctgtctttatcacccagtctggaaggcagtggcaacgatcatgcctcactgcagccttgacctcttgttttttttgtttttttgaggttatttttgtagagccagggtttcaccatgttacccaggctggtcttgaactcctgagctctagtgatcttccttccttggactcccaaagtgctggaattacagatgtgagccaccaggccagcccaggttagcagtaaatcttgctaagattggcccataaagaataccctggcttggtagactgtacagaagaaggggagactcggagaccacgtcctatgccatagccactattagagagacaggagccccaagaacagtcgaagaggagtggagtttaggaaacaatcagaacaatctctctcccctggtatggcagccgcaaggaaggggcaccctggggagtcagcccagggtagagaagtacatttggagcctttaatcagggaagcttgcagggctgcggcactcaccgcaggggacaccaccagggggaaagcaggcaggagccatttgccttccctcctcttcaatcctgtatctatgtccctgtgctgctgaggtccaggagctccttagggatgcactgtgtgtacgcgccttagcacgctgcacaattccggacacacggggtgcttataaagcgctgtggtgtatttagcagcatcctgtagccaccacatggtgcccagacagctgcaggctgaactcaagtgccccaccccctggtgcagaatcctcagatccggggactcgcgcgggtggctcagcaccgccctctgtctgttcttaggtcttgctcagaggctgaagcagggtgggctttctggctcacagggccatctgaccactcccctcctggccattccccctcctctctcaggacatatgctttccccaagatggagaggagagccagcctgaatccttggtgtttgtaaactcctttcacctggaaattgctttacatgttttaaacttcacattactctttgggagaagaaaagaagtaacaagtaatattcaatttcacacttgggaaacaaacagtgaagttaagtaactttcataatgccagatagcatatctgtgttaggaaagaatgtgtgagtccatataaaattctgtcctcagacgtttctcaagtgtgttctaaaataaaaggcttctgtactcaaaattgagctttgtccctgttgaatagtaaattaagagttcaaaatgagacagtaaataagttagaccaagtaagtaagctgcctttgagtatggaggtagagacataaattcgtatgattaccatagaaaacaggcagcactttcctgaaagaagagcaatttttatatcttaaatataagcctttgaaaaatacggtatttgttgataaaaggaaacttctaagggctgctactatatcttgatgacttaataaggggatctccctgtggatggggtaagttaaaagagattatttcttcagtttttctttattcacacactagtagcaaaattagaaacatcagtgagaaaattatatctgatttgttgatataaccttatgaactttccattataaaacctgaaattaaagtatatgttgttttctttaatgaagtttaaagaattggaagaagacatttcattcagttagtaagtaaaagttgtgtgtgtgtgtgtgtgtgtatacgtgtatatacacgtacatatacatatacacgtgtatatacacgtacatatacatatacacgtgtatatacacgtacatatacatatacacgtgtatatacacgtacttatacatatacacgtgtatatacacgtacatatacatatacacgtgtatatacacgtacatatacatatacacgtgtatatacacgtacatatatatatacacgtgtatatacacgtacatatatatatacacgtatatatatatatatatatagagagagagagagagagagagagagagagagagaaagagagagagagtctcacctgttgcctaggctggagtacagtggtgtgatctcggctcactgcaacctccgcctcccgggttcaagcgattctcctgccttagcctcccaagtagctgggattacaggcgtgtgccaccatgctcagctaatttgttgtatttttagtagagacagggtttcatcatgttggccaggctggtctcgaactcctgacctcaggtgatccacccaccttggcctcccaaattgctgggattacaggtatgaaccactgcgcccagccaaaaattgctgtatgaaatagttatcagtcaggagcaggagctcacacctgtaatcccagcactttgggagactgaggcaggaggattgcttgagcccaggagtttgagaccagcctgggcaacatagtgagaccctgtctgtacaaaacataaataaaataaaataaatagttgttattctattgtaccatcaccttattatgtctgagcagtatttgtttgatgtaggctaaaaggtgagaagagagaaacagaaaactgtgatcatgattatgccttccaaggggcctaatattgaactgtactaggtcgactattaacagactaaaaatgtttgaaagcgcatatgcaacaaaagtggtttttatcccaagaaaagccctggataggctgcctggtccttgggttgctgtcttccatgaggtgattcagagacacgggctgcttgggtcctgcagttgtactgtctaccagctcgcctgcagtcagctttcggaaggaaaaaggaatgaggagggagcccacctacctcttacaaccctggactggcctggcccagaagcatcccatgtcatttccaccacccttccaccgaagagaacttgtcacatggccatgtggccatgcctacctggaaagagggttggaaatacaattcctggctggggtttaaatgtgtattttagaaatgaaaatagattttcgtggacagccagctcagctgcctcagaggccttcttaagctgcattagcttagactttcttatttagccacatcctgattcaatgtgaatgggcctagttgttacttttaagagaaagatagatctacagagctgaatcctttttcagtagatagaggaagtaactttctgaatagagttcagttaagaaggaattgctagggactttcttgctagaagaaaatctgccctcatttgtactagagaggtaaaagaatgcagggttcaaggaagacggactttcacatggtactcccagcaatttcatgagatccaaagcacatggatctcaggactttgagtgaggaaggaactgtccttctcaaagcattgcagcctgataagggctgaaaaggaggagggacttggcagaggacctgttaagtaatcctctggctgttcgccttgcaatcagaacattgtgtaggtttgataaatttcatgtttttcaaaaaaattctctattcatagttacacaagaaactgtgatgagatccccttaagagaatattaatgctatcaatacagttactattattccagcacctttagctcactcttgccactctttggcgctctactttttaatataaaccatacatagagagacaggagccccaagaacagggaggctggccaagctggaaaaataatcaaagcattctctgtccctggagccccagccgtaagtggacaaacttcagttgccggaagccaagaccactggagagaagaaaattgctagtaccagtgtgggagttgtactgtcgtcttctcttttataagcatggtcacgaatgacatgtgatttgaaaccacaatttactaccgtaataaagtttctaaaattactgcagtcggactccaatcgtattgaacagtcaattgattctgggttaaaacatgcttacatcacaaaataatgaccggtttgagaaaaataaggttgtcttcaggagccaatatctcagtgcaagacggacactattaaaattctttaggggaaaataaattgctgatttgctaagtgtgcttgaagcaatatcaccttacatctgcctaatgttctttcctcacagcctcccagtgaaataggtaaagcaggaatttcgactttatagagaaggatctagggatatgagaatccatcatgtgagaacattttagataagtagcggaacccaattcataaaactctttacactgctccaagtaaaacagggcagccagtggattgacacacactgtttttaaagaccagatttagaggtatgctcactcaaatctgttaattctgatcagtgtgaagaacgaagttagtgcttttggatattaagatagttggtataggcaaacaatgaaatttaaaagcagtcactcgactgtaagtatttctttcttacaggaaactgtttttgcagtcttatggcaaattttgaggcccaactctcacccttttgcatgttttcctgtaggaagtaaatgaattctttgttttgtattttgttagcactttctaaagtatttgttttcatttggttttatccattgcaaggcaattgttactgattttattctttgtcgttgaatcatctccaaggttataagttatgttaaaaaacaacttagcctttaatgcttcaaaaactttaaaaggtgggtagtgggaacatcaaccactgtgttctctcatataatcgggagctgggagaaatcacagcagattttgacagtgtcctcagtaccagcagaccttcctgcagaagggtgtccaaacttcctgggctttattcctctattaaatgttctaccaactcccccaactcttctctttactcaacccttgacatgaaacacctttctactgtgtagtccattagggtgtaaatcacaccaaagaatttttgctcaaccactttgctagatagattggaaagaaacaccatttattgcatactaatcaaactgtaattgcctgtcttcctgataaattgaccatgaataaggtaggtctctttgactgacagtcttgggaatgtgcattgcagtctttataggcatgacatgcttctgataagaaagcaggcttgctgtgaggaaggaaacaatgtttccctcttttgaagggactgattttcacaattttcacttgcatcataaataggtgttggcaaaagtatcactcactgattatgtacatggcagatagagaagcatgttacttttagtttaaaaaacaaccttgttgccatgttgatttaatcagagttctgtttgtttgtgtcttctcatctaatgtgtaatcagaaccccttaataggaagtggtttcattccattgctctgtattctggagagaaagtctgatgttggatttatcattaacgtttgccatcagcttgtcaccaccaaagccctctgaattattttctgtgctctctataaggctggttctgctctgccatcctctttttgccagggagagaattttctttttttttgagacggagcctcgctctgtcactcaggctggagtgcagtggcgccatcttggctcatggcaacctccacctcctgggttcaagcaattctccagcctcagcctcctgagtagctgggattataggcacacaccagcgcgtccggctaaattttgtatttttagtagagacggggtttcaccatgttggccgggctggtctcgaactcctgacctcgggtgatccacccgcctcagcctcccaaagtgctgggattgcagacatgagccaccgcgcccggccgagaaattttaaaatgagtcaccaggaataaaatatattaaccaagcgaggtccaccgtttattcagattttcctagtttttgctcaatgcctcctttctgttccaggatcccatccaggataccacattacatttagtcactgtatttccttaggtttttccagtctctggcagtttctccaactttgctcgttcttgatgatcttgacagtttgaaggggcactggttaggtattttgtaatatgttcttcagttggatgtttctgatgtttttctcatggttagactgatgatgagtttgaggaggaagacagcagaagtgaagtcccactctcataccatgtgaagggcccatgccatcagcatggcgtgtcactgttgatgctgaacttgatcaccgctgaggtagtacttatcagctatctccactgtaaagttactccgtttctctttgtttttgtactacttctacctattttaactctagctgtcctgcaagtgctgtctcagggttcactccttctgggtatcttctcttaaatctgaccaacttagtggaatgtttcaccacagacataatttcaaatagcccagttattgagaattgcattaggaaggaaggcgggatgtgctcaccacctcttagctgagtgactccctctgtgattccatcacatctcacaactgtagtcttttacacatgaataaatccccaaaactcttcccagcatttctttctggtcaacagtggagaaaggccttgtgacattgagaagagaagttggccatgtagtcatgagttagcaaattccagtggctgtttctttttttgagacagagtctcactctgtcggcctgactggattacagtggcacgatctcagcttactgtatcctccacctcctgggctcaagcagttctcctgcctcagcctcccaagtagctgggattacaggcatgtgccaccatgcctggctaatttttgtatttttagtagaggcggggtttcaccatgttggtcaggctggtctcaaactcctgacctcaggtaacccgcccactttggcctcccaaagtgctgtgggtccgtgagccaccgcactggaccaacagtggctatttctaagagacctatctctctaaaaaaaaaatctctagaaaaacttgtatttaaaaattatgaaggcaactcgagggagaatataggatgccaacggtgtctcctgaccttagcctttgcgattaggtgctgattgtgtgaaatccggcttgatcatttgctttaaccatactgggcaacattgtccttgcctggaggatgtttatatttattttaccatggcatcaaactttttaggatattaataaagtttggatgtaagatctaatgaaattaagtgttctttatcttaggaaaacatcattttgttttgcatttgcaggcggagttagcatttagatattcaggtttgggactatgaaggtctattctcattctggctaatatataattccttaacttaatggttctgttgttgaaagtgcttgctctagcgctgtattcctacacagtagcctagactattggtcgagggggaggatttatcccttaggaaacacttaacaatttctggagacatttgtggttgtcacaactgggtgggggccacatttgccatcttgtgagtgaaggccagggatgctggtaaacatcctgaaattcacaacctctcacagcaaagagttatctgacccacaatgccaacagtgctagatatgggaaggttaattggttggccacattacctttgcttcttgtctggggcagctttccctagaccctgaggcatgttgtatatatacttaattttgttagatcatcccagagaacatctgcggccctaggtcagcttcacaatgagtctaacttctagatcagtggtttccattgagcctgtgtgaacacgaagatcttttttaatgaccagaatttttagtcttataatttttgagctcttattatttaagaaccgagaaaatcctcggttctcggccttttggctaagatcaagtgaagaactgagaaaatgtgtgatgatgctaacatacatgctatctcgcatgcagtggctgtggatttagtaacatatctcgagtaattttcattttgttgaacataacatttggaaaacagtagtacatatatatgtatatatgtgtgtgagagacccattatttcattattcattctacagatagtacttgggtacacatggatttgatggcccctagcaggaaatatttgtcctcatagagaaaacagcccacagcttagggaccattgctgatgaggatccctttgaaacagagatgacttggagaacactcacatctgtagctgaaacaaacagtctaggaaatagggaagggcatctcagcctcacatacagtgcccacttattaaatttctgcaaatgatgggaggtgctctgttgtggttttcatgcctgttgttaaaggaatctgacagccgaggcatcaggctgctttcttcagccctggtgagagtaggagctctggagtgaagccagtgaatagaactttgccaagattctgaatcttctgggaccatctgtgtctactttttcaaaaagcagattgtgtgaaatgacaggtgggtaggacacagaaggtaatagagatgtgaatgagaagactctaggaagggagagagcaagtacgggtgccagcgggaagagcccagcagaagattgagtgtcctggcagcaggactgagaggatgaggtcacaaatggcttttttctctgggaaggaagccagtggtgtgtgagttgtggcttgggttccagatcttagatcagttttccttacacacaatattaacgttcatattccttccaggaaactatcaagagtaaatggatcaacaggcagccaattggaagagcctcagacatagcaagagggtggcatggagggagaggacatataaccctctctttggcagctgtgcctaccacactctggccttgaagattctgctttggctcccagactagagacccttttgcatctttgccatcagtctttttggaatacagcatcaggcctaaggtcccagatgaaccttaggacagctttcattttgaaaattttggttctcagttcacattttctagctttccattgagtggtgtatcagttagctgttgctgtgtaacaaaacccctctcaaatttagtgacttcaaagaataactttttgtgatttgtgccaagcctctgggttggctaggtgtttctgctagtctgcactcactcatgcatccatcaccgcagtggcagggtgacgggcggagagctggtcaaggatggcctccaatagatccctcatgttcttccttccacttctttacatccttccataaggttcacatgggcatgttttcctggcagtgggtccaggagagaaagaaaaaacatacaagtgcttctacaagctgctgcttatgtccagtttgctgctgaaccattaggaggcgagccccgggaccgtgccccgagtcagcgtgggagggcactgtcacaatgtggagccactgatcccatcactctgccattgctggtgaaatacaaggaagccagctgacagcttccgacgagttgccagatgacgtttcttctgctattctttcatgtttagtagtgtcgctttgtagcaacacgttatgtcttaatctgttttgtggttgagatgcacctgagcaggcatctggactaggtgttttaagtagctaatttttctatctcttggtcattttgtcgtctcacctattgtgatggtgatagagccccaggaatacaaacaccatattccaatacagcatgttcagaagaactgaataaaaggcatacagatttaggaagaaggagaaaaaaattctccatggagaagaacctcctgcttattttaggttttattttattttatttttttgagacagagtcttgctctgtcaccaggctggagtgcagtggcgtgatgttggctcactgcaacctccacttcccaggttcaagcgattatcctgcctcagcctcctgagtagctgggactacaggtgcccaccaccacgcctagataatttttgtatttttagtagagatggggtttcaccgtgttggtcagggtggtctcgatctcctgacctcgtgatccacccgcctcagcctcccagagtgctgggattacaggcgtgagccaccacacccagcagtaattttatttttaagatggaagggtgaatgaaggaatatttgttagcagtgactacacagagttccagtgggctttctctgtgttgaagtaggtaggaaggtgtagggaattggtaaactccgactattttttgttttgtcagtagagcgtgggaaaacggctgattttcaaattgttgtgatgaaacgaatgctggggtatttataggcatgtgtaaataagaagaatatatctttgtcaaaaaacagccaccatgttatttggagcttttttaggtagaataaagtagaactttctaaaagtccgaggaaagatagaggaagattttttaaaaacttgacaccattaatttctgctttgtccaattcatatttatagcatttgcatccatcatctctttaatagttcggttcggtctgagctagttatttctttcacatatttccttttttgttcagtgctaataattacacttttgttctcttactggcaaaacattgcattgtcctcgggaagcattcaaagagactgagcagcaaacgctaattaatcctcgcagtgtgtctccttcattcctttaactgaggcgctgaaatgtctagccacacatttaatgaaatataatttggtgacagagagggtacgaaaactttaattcaagatgccatagcagcttcaataagcctcatatggccatggttgtgaggcagttcaaggctttaaatatccttgagatgcaggtgtggtgactagattatctttctgtgttattctccctttctgacagcagtcatcctgacttgctgtggagaatgagtttatcttgagtggaagttatcctggagtctagggaggcaacctagtttatagcaagtaatcttgggagttacaggcttgtgttttgtttccgtttttgtcagttgtctacacgttgacaagtgacttcatccctgggaatcattattgcttatcaccaattaaacacaatggatattaggtagttcagtgatgagcttaaaagagtttgacaagtttcttggaaagaacgttaggtaactatggatggctccctgtgcaatgtcttaagtctttaaagaatattttaatttattaccttatgtccttaaataggtcccttgaaccaaatttagtatcccagaatatgcattgtcctaagaacttttgcaggatgacatggaaacagatactataattgggaagcctcctaaatatgtgcaggtaggtagtggttataaattatctgtagcgtctcattcattagagactatcttatgagttagtgtgcatgattgatttgtagaaactacagataataagaatgctgtctttgctttaaccggattcatacagtcttctatccagggctggaagttacaagttgccctgctctggaggtccgagtgctgagcagtgagtgactgtagacgtgtggcaggcattcctccctccttgaatcccatgtttaaggtctgtgtttacctctagcccgcgagttccaaaagctatgtctgtctcacttggctttgtttttctagcccttactacagtgactagtaatgaagtaagtgcccaaacacagatgtatgaaataaagagagaaatgaaagggcaaataaggaaactggacgttgcttctctctgttgtacttaaggcctgttgcttcacggcccttccctacaggaggctgtaacactcataacgccgattatgactattgtgagaacaaattggcttccagatctgaacagaatcgcacataagaatcacctaggaagcctgttctggagtctgcccagagctactgaccgagatctccaaagactgagcccggagagctttttattttcaaaaggctcccaagatgattcagatgtaagtgctctgaggattcatgctgggaacagatccagatctgctgtaagccctggctgtgccctggacccacagctcctttccttgcccaggctccccgtgagatgaaggctcgtggaacacatctcatcttcttcatggcaggtaattggaatcaaggagctatagttcccttacctatagtaacatgctgaaaattaaaaccatagttgttcttacatttctttgtatcattaggtgccccactgccaggcctattagcagagacctaatacataattggtgttctggaagaaatggaaggatggatacatgaattctgtgacttaaaaatgaaatccacatggacatacctagatcaggaagaatgttgaatttgtctttacacaaattagcatgaggaaatacttctaccccaaattaataataggtcctgaaatccatttttagactttaatccacttatagatggtgttaagaatgatccttgaaaagggatgtactttagtatttgtctgttgtagaattgttctttaactatcaagtcagtacttcagggttaaacattacaagttcaagatactatctaagattagttaccatctgcagcttaaataatgtgtcccttcccaaactccgtcaaatgaaataaccattaattaaaccccggttcttttccaattggaggaaggctgcaggccaaattatttttgtgatgtatgggacatctgtaatgagtgccgctcaagtgtacctgaagcccttcatcctcagtgcataggactggagcagttgaacagcctctgtcttataaacagattatagtattgttaggattagccagcttttctttggcaatttttttcatctcaagtagtccatattttccaagttcagcacgtagcaagcagtcagtcctgttcttggctgaagtaagcagtctgccttgagtgccctgtgtctttcattctcccgacgtgcacatcccctatgtgttcctcattctccccatgggtcagttaagacctctgtaattacagaacgctccctcaagctagtggagaatgtataatttggaatgtagaggtatctccagaatcatagggcaggagtccagctccattaattgcttttactacatagcagcttgtttcttctcaacttaaaaaaaaaaattaattgtggtagaatgttcataacataaaatttatcatcctaaccattttatatataattcaatagtgttaagtatgttcccattgttgtgcaacccatctttagaacttttttaccttgcgaaactgaaaatctgtacttgctaagcagtgactctctgattccccttcccccacagccccaggcagccatcattctactttgtctctatgagtttgactactctaggtacctcatataagtgaaggcagagagtattttgactttgtgtgacagacttatttcacttggtataatgtctccaaggttcacacatgtggtagcgtgtgtcagaacttcccatttaagactgaagaatatttcactggatgcatagggcacggtgtgtttacctgtttatccctccacagacactaaggttgttcccacctttttgctattgtgaatgatgccgttatgaacgtgggtgtacaagtatctcttcaagaccctgtcttcaattcgtttagatagatactgagaagtattgttagatcatatgataattctatttttaattttttaaggaacctccatactgttttccgtagtggctgcaccattttacattttactttcccactgacagtgcacaagatctccagtttccccatatccatgtcaacgtttgttattttgttatttatttatttattttctaaataatggccatcctaatgtgtgaagatgaacctactctctcattgcggttttaattccattttcctgatcattggtgcaacttagcatcttctcatatgctttttgctcttttgtaaaccttctttggagaaatgtccattcaagtcctttgcctgttttttaatcaggttatttgtttttctcttgttgaattgtaagagttctttatatattctgaatattaaccccttataaaatatataatttgccagtgtctttttcttattccgtaggttgcattttgaccctgttagttttgtcctttgatggcacagaatttttaaattttcatgtggtacattttatctacttttattctcacacttaatatataatctagttacttcttttattttctgttcttttaaaaactttataatgagacattaaggttttgttttgttttgtgagacagagtcttgctctgtcgcccaggctggagtgcagtggcacgtctcggctcactgcgagctctgcctcccgggttcacgcccttctcctgcctcagcctcccaagtagctgccatgcccagctaatttgttctatttttagtagagatgggtttcaccgtgttagccaggatggtcttgatctcctgccctcgtgatccacccacctcggcctcccaaagtgctgggattacaggcgtgagccaccatgcccggccacattaggggttctttttagctgctatccccagtttaattcctctcttccccactactgtgggagtttttctaagctttactgaggtatagtcatatatatgattatatatataaggtatacagcgtgatgctttgatatacatatgtattgggatattattatcaaaattaagtaggcacattcatcacctcacatagttaccattcttgtgtgtgtctgatgagaaccactaagatctacttttctaacaaacttcaaatgtacaatacagtattattaactgcagtcaccacgctgtagcttagatcctcagaacttttgcatcttataactgaaagtttgtaccctttgacgaacatctgtgcctcagccttggcaaccagcattctactctctgtttctaagagttgtacttttttagatttcacatataagtgagatcatacagtatttgtctctgtctgattccactcaggagaatgccctcaggatacatccatgttatcacaaatggagggatgtctttctttccttatggcggaatagtattctaggtgtgctctgcagcctggtggagtggcaggctgtgccctgcagtcgggtgggggaaccctgacaggaccccctgctgggcagggccataggctgggctccgcagttggaccggactgctgtctgggctctctggtcaggtggtcaatggggttgctggttgatctccctgtttgggggtggctgcaggctgtgctctgccgctaggcagtgctgtggtctgaactctgtgccctgggtggtgcaggggggcgtccactgtgttccatagctggtcagggtctctggctgatttcaggctatgctgctctgctaggtggggcttggctttctgcctgaggagagctgtaggctgagccccagggctgagccagactgctggctggggactgatggtgggcagagctggtgactgccctccctggccagatggtgacactggttcagctctgtgggtgcagtgccactggctgcgccttctggtcaggcaactccactggcagggatttggtgccaccactgagatacacgagctagttgctttgagccccatccttctttgttcctagccaaccccaggtggtcttattttcccagtgttcctgtgagacaagacagaaggaggcatcctgggaagtaccctgcaatgctagggaagctggatgtccaccttaggctctctttttccctactggaaaaacatagcttaggggaagtctctttgtctagtgctctaccagactggggaggggcagcatgaccaaaccaaatccctccactcttcttacccttctaatgaaacttttcttggtttctgtggtccaaggggttggttctgcctcatccccttattctgggatttccacaaaggtgttttgtctatagatagttttgctagttggttgttttgtgaggggacgaaagctggggacctcctcttctgccgtctttcttttgttgcctgtccttttcttgttacatccaagaaatcactgctaaatccaacatcgtgaatcttctctcttatgttttattgtaagtgctttcaattttaggtcttaggtttaaatctttgttctgttttgagttaatttttgtatgtggcgtaagataagggtccaccttcattcttttgcatgtggatgtgcagttttcccaatgccatttactagagactgtcctttatccattgaatggtcttggcacctttgtcaaaaatcatttggccctatttgccagggtttatttctgggctttctaatctattacattggtttgtatgcctctctctgtgccactactatgctgttttgattactgtagctctataattcattttgatatcaggaagtgtgggacttcctatcttgttattcttttgcaagattgttttggctttttgaggtaactttaaattccatatggcttttttatttctgcaaaagaaaatgccattaggaattttagcaggattgtattaaatctgtaaatcattttgggaagtattgacatcgtaataataagtcatctgatttgtgaaatgggatgtctttccatttgtgtcttcttttatttctttcagaaatcttttgtagttttcatagtatgagtcgtttgcctcctttcttaagtttatttttaagtattttactctttttaatactattgtaatgaaattgttttcttaatttccttttatttgttgttaatgtgtagaaacacaactgttgttcattgtgttgattttgtttcctatcattttgctaaatgtgtttattctaacaggttttttgtggaatctttagtgtgttctatgtataagatcaattatttttgtttttttgtttttttaaaatatttccttatttttttcttatataagatcgtttatctaagaatagaggtaattttacttcttcctttctgatttgcatgcctgcatagctaatccttggttgactgtttttatttctgaactttaaatagatcatcccattgccttctggattccatagtttctgatgagaagtcattcattcatcttatttgctgttcttttcttgacaagtaattgttttcttactgctttcaagattttgttctttgccatttaacagctttacttttatgtagctgggtgttgatatctttgcatttatccttcttagagtttttgagctgcttacatatacagaccattgttttatattaaatttggtaagtttacttcattatttcttcaaatacttttccagtattctttctgttactttcccttccatcttctatttctattagttgtgtgttggcacacctgttggcatctcatatttttctgagactcttccttttatttctctttgttcttaggattgagtaattgctattagcctgtcttcaagttcagtgattctttttctgcagattaaaatatactgttgagtccctccagtgaatttatttgttattttaccttttaaccaaaattaatacttttaaaataattttcatcttttaatattgtttgttgagacgtagttctcatactttaattctttagaaattatttatcttttaaaatataattaggatagctaatttcaaggtttttttctgtaaagtctagcataccttaggggcagtttctattgattgctttttttcccccgtgtatgctccataccttcctatttctttgcatatttcataaatgttttttaacaactgggcatttgaatgatataatatggcaattttggaaatcagatttcctaccctatgcagaatttactttttatattgcttctgtctgttaagtgaccttcttaagataattctgtaagatatatattctatgtatgtttagcctctgaagtctcttgtcagttagctaagtggtcatctaataactggatacaggtttctttaaattatttgagggataaatctccaagcctttgggaagggacttgtgtgtgtgtgttgaggcttgcctgctatgtgctggcaggcagtttacaaccctccacttgcttgcttagagccagaggtcagtcagaggtgacgtacactgtacgtcaaattgtatgtcagtctgtcatgccagaggtgagatattagagccttttccagtgctttttctggacatgtgcttagccctgtacatgtgtgtgaccttctgaatttccaggaataagtcagagcagttcagaatcccctatggccatgtcattctccagtttttccatttaaggtttttggtctgttgcttgttagccccagttcatattgctgcctcagggaactgtgatattgagcatgtgtcacagattgtttgccctagggatagggctttttgcacagatacaggtcagatttaggtcagatacaggcaagcctaagaatggagcttttgaaggcagcttcttgacagataaaatagtaagaattatctgtactatcccccttagtggcttcaaggctattgtttttcacagctcctgtagttgcaagactgttggttttcaagggtcctgtggaactagtggaaggggtatgggaatagggcaagttaaaacactttatagtttgcttattcttaacaagattcgtctgtttttcttgaataaacagtacttagattgttgcaagcctttgattaatttttagagttccaaaaatgttgatttcacaatttttgtccatgttctcattgattttatgaaggagatgattttcagagacttttattctgccattcctgaggtccttcttttctcagatgacattttgtggttcatagcaaccatagaaacattctgtagttcatcaggtgtggacacagggaagggtcactttgtatagaaaggctatcagggacctatccttgtgattaatctacctgttgcctccctctggagcctcatggaatgtggtgtctgtggattatagaaaacttggcttccttggccacatctccttgaaaattccatcctgccacctcctgtataccaagtggatgtgctgagcactctctgaagtgctaagaaatatgtcagagagcttgctgggacagtctttccctctaaccatgggactggccagtgtgttttgagtttttccagccaatttttggagtaaccaaaactttaggaaggccctgtcagcccacctccctcactggcacactaagcaggaatccccagccccctgttctcccagctcccaggggatgctcttcatctttgctctgtgatcctgcagtggtctccttgtgtgggaatcgtgcaccccactggccatgccatatctgtgtgaagcttattttagctgtcctaatcagagcatgattaaaacaattgatttttaaaactgttgtgtatgtattttatctgtgttattcttgaatattggattcatattaaatagtagtttgccctaattaactttaatactacagatttgtgctttttgaactcagcatgcagatttatgtaaattgcataaagcctttaagctaggagtgtatcatttacatttacaatcccatttatcccatgtctccatatcactgactcttcaaagaaagacaggaactattgggatggacgtacttgattgtttcagtttcactcctgtgcaaaccaaagaacaagtagtaaatgacttttccacataaacacacacattcacacacacacacatagatgcttgtgtgtatatacgtgtgtgtggacctatctttggatgctcatatatgtgcacttagagaatcaaaagcaatatccaggtatcttgaccataagcccaataccctgtctatttttttgagtggcaatttgtgttcccatattgtagtgtgcatatatatatatatatatatatatatgctgtatttttaaactgattttagaattagcgcttaaaatagaaaagacagagcacaaatttggggggggagcagtttaaattttgttttcatacatctggttgtattaaattctctgttcctctttttttttttacccccatttctttgcccttctttcttccctttcctccccaatgttttccgtatctctggcaaagttcatgacataaagggctgtaagagatcagattatgttaccccaaaacacaccactctggcatacagattacattgagctgaaaacagttaagaaaaagacacaagatgagctctctgccttttcccgtctgcctgaaacataaaattttccttgtgaacgtgttcctcccagctctacttccggtaaggagaatttcccagaaaaggagtaacagcctcattactggagatgagaggacaccagaaagggcttacacaaaccagccctaggagccagccatcatctcccatcagtttctcccgacatttgcatatttgccttcatacagtctgccacccctagaagttcaaagtccatttcctttgccatgtcacttctctttagcatttttgtcttttttccaaatagtataaaagcttccaagcacagccattcttatgaagtcctcctcccacccctttctgtgtaaaacttttaacaccaaataaaattatatactttttattccctgtttgtctgcctgttgtcagtttatttcacagacccagtcacagaaccaaagagggtggaggaaagtttttcctttcctacaaggtcagtgtccttttggatagaggtcgaatggatcggttattggaaaagaaacccacagagaaatatgttagaaaggaatttttgcaagcaaagaaccaaacaaacaaatagcaaattgtacgtcatcagtggagactggttttctaccagatgaatgaccctcattaacatgaggaagcatgtatggatattcagtacacatggtcctacttattgataggcatgaatttgattgtacggaactttcctggagcaatgtacgtgttgtgtgtcaggaaaggctctgttcaggaatgcgataggccttgggtgccttgaatgggagagtaatacgtaagcagaccaactgatgggaaaagtctcaatatagaggtaagagagggtggggagactcatgtgaggggtagtttaaaagaggcagtctgttaagcttatgcctggacgtaaatagcagatgaatttggagttagaagaagtttcttggctttcttggtgaggtttgagactcgggttctgtggcggtacagtcttgctaagtcacagatttttgaacccaaaacattcagcccattctccttgtcacaactctcttacctcttttctcatgtaggcttctgtatacagagctagaactggcaagttagagtggaccttttactttaattgtggaaggagggcaagcagcccctgagaaaataagagtctctaacaaaatgcacttataccctccagacctgtctactttaccagaatgggtgtgccgggatacagaataccctagtaccacaaaataacttcaactgcaaacaattaaactagtaagtatttaaggaacatttgctatgtgccagaaactgcttagtgctggatatgtattagtcgttgtaagtagatgtcggaggaggaggaagagggtatatatcaccactgtgtgtacgaaaaaaatgatataaagagttgaaccgagtggcatgatgagaaaaacttctgcttggatatcattgtatgaaagggcgatgcctggaccttactggccacaagttagcagctatctgcccccatgaatggatcataaaagatgtcttccaatgtgctgacatcatgtagccacaggaccaatgctggaagaatttcctgtggcgttattatcctgtgtaattaataagacactattaatcaacagcttgactcacagattctgtgacttgcatccaaagcccactactggatgtctcaagtctttgccatctctcactttatttcaatagcctcctagtttgttcctgcctcaggatccttccgcttgctgttcatctgccttgaatgctattcctaagatttttccatggcctggtgccccactttatttagttggtttctcaaatgccatctcccaagaaaggtcctcttcatccaaaatagcccccctccccccatctctccaattactgccgaaccccttacgatactttgactttctgcatagcacgtatcactacctttctttccatatatacatttagcttctttgtctgttcattgtttgtaatgtctattctattataatataagcatcattttgggcacagacttcatctgccaaacatatactaggtatccagtaaatccgatcaatgaattcatacagtataacctagcaaggaatatcatcaatgaaaaaaagaaaagacacaaaagacctaaaagaaataagaagacaggccaggcatggtggctcacgcctgtaatcccagcactttgggaggccgagatgggcagatcacaaagtcaggagatcgagaccatcctggctaacacgatgaaaccccgtctctactacaaatacaaaaaaattagccaggcgtggtggcgggtgcctgtagtctcagctactcgggaggctgaggcaggagaatggcgtgaacccgggaggtggaggttgcagtgagcggagatcacaccaatgcactccagcctgggcgacagagtgagactccatctcaaaaaaacaaacaaacaaaaaaaaacaaaaagaaaaagaaaaacaatttaaaaatagaaaacaaacaaaaatgtatagtatatccaaaataaagaactgctttttttgtggttatgcttttctttttccctcacgaaggccaaatctcctgtgtgcttcaatagaaatcagtgatgagaaaaaagtagcaggtatcagattaaaccggcctccatgtgatgatcatctgttagctttagtattgtctcaaatgaaaaactcacaaaacactccaagttccctgccattgctgaatttaatctttggaatgttttgaaccccgtgcatgaattatatcaattttacttagggaaggtcctgtggtatctcaaagtcacttagctcagtttctctaggttttgtgggaatattaccctttaggtatgtaaataatatttatttcaaatcaaaatcataagtgaaatcctaaagcattgctattaaatgtctaggctaaaatgaagatacctgcttttgccactactattttgaaatgtagactcacaagaagttgtaaaaataatgcacagaatcctataaaaccttcaccccacttctgccagtggtgaaatgttgcataactggagtgtggcataaagactgagaaactgacatttatataatactgttaactagaatagaaacgttactcagttttcactggtttcagtatgccctcatttgcatgtgtgtgtgtgtgtgtaaataattctaaattctatacaatttgatcctacgcatagattcatttaatcgcctccacaatcaagatgtgcaactgatccgccatgacagaggaactccctcgagcgacccctataaaactcccctgttgcaccccctcccacctcattgcccctgccgtttaacattgttttcaaatgtctagccaatataattagccaagataagtagtagtaacactattggcaaagaaaagtgagaatgaaacatatcattatttgcaaatgatatgtttatctcttgagaaaaatccaaaataatggattgaaactattaatttgagattttctgtataattatgattaagaacatacactctgaagcctgctatgtgggtttggatcccagctccaccacagactagctgtcagtcctctgggaaatcacttaacctctctgtagaggtttccctcatctgtaaagcagggctagtaagagtacctacctcactgagttgagaggattaaagaatataatacaggcatacctctaagatattgtgggtttgctccagactaccccaatttgcaaatattgcaataagtgagtcacatgaattttttggtttccagtgcatataaaagttatgtttatactatagtttattaagtgtgcaatagcattatgtctaaaaatttacataccttaattcaaaaatactttattttaaaatataatagcaatcacctgagccttcagcaagtctttttgatggtacagggtcttacctcattggtgatggctgctgactgatcagtctgatggttgctgaagggtggggtgactgtggcaacttcttaaaataagacaacagtgaagtttgccccatcaattgatgtcttcctttcacaaaagatttctctgtaatgtgcactgcttgctgctcttttacccatagtagaacgtcttccaaaattggagtcactcctctcaaatcctgctgctgctttatcaactaagagtatgtaatgttctaaatcctttgttgtcatgtgaacaaagttcagagtgcctccaccaggagtaggttccatcttaacacatcattttctttgcttatccataagaaatacctcatcattggttacagtttattatgagattgtagcaattcagtcatgtcttcagactccactgctaattctagttctcttgccgtttctaccacatctgcacttacttcttccactgcaatgctgaacccctcaaactcacccatgaggggtggagtcagcttctcccaaactcctgttaatgttgatattttgacctcctctcatgaatcccgaatgttcttgatggcatctagaatgatgaatgcttttcagaaggtttttgattgacttttccaagaccatcagaggagtcatcatccgtggcagctatagacttacaaaatgcatttcttaaatagtaagacgtgaaagtcaaatttactccttgattcataggctgcagaatggatgctgtggcatgaaaccaacattcatctccatgagaactcttgggtaaccaggtgcatgatgtaatatataaattaggaaactaggagagaaaaatccaggcatgataatagaaaattttgcaaacagtgtgacacagaactacctaggtaaatagatggaaaaagtcattctcactggtaattagaaatgtattttataccataaccaacatttagtttctactacccaataggcaagtctttagaaaataatgacataacaaccactgtctgtgtgtacttgtaagggtggagtaacatgtttgtgctattttcttgcaatatttattgaaggcattcaaagtgtatgtaacattctgacagttaaattttaaagaattctgagaattgattagatgcactgtggcttttgtttactaagattttatttatagtcattcttttatttagcaaatgctgtcgtgggccttgtctatgcaggacagcatgctaagcactaggaatagagtagtgatgaaaacaggaagacaagcattaaataaatcatggggcaaagggaaataatcactagtgttgaaagaggaagtattgtactaggtagctgagggcctgtaactagaggatttaacttagcctggggtgtgtgtgtgtgtgtgtgtatggtgaggggttttcactgaagagttgatgaatgttgaaacgcagaggagtggtaagaggcagggaggagggaagggaggattaaggtgtgaggtaaccagcagcagaccctgtacagggaggctggaggctggagcagagagaggacatgacggggtgaaaggtaactctggagatataggaaggggtcacagcaccttttaggaaaatctaagattttagccaggaaactgatacgaaaaataatgttttcaagggagatttagtaatacaattataatgatagaatattagtatatatttgattatactgtatatcacagttactatatgtgttatagtatgtatcatgatcattatatactatataaccattaaatgatattttaatgataaatgatgacataatagttaatgctataatattaaacgttgaaagcagggtacaaaacagcatgtttggtttaatcctaattttgaaaaggaaaaatgatgtatctaacatacactgaactctaaattgtttttacggtgatttttctgtgtagcaggatagaggctgcttttttatagttcctttatttcccggattctctaaaaatgaataggtgttactgtttacttagaaaaattgtactatttgagaaaaacagatttagtttatcttggaacatttcattgaatagcctgtatatattataacgggcttatggaataatactgaaaaatatccattaaatggcgagtagtcaggtccagtgttggcttttgtccctgtgaggtctccttcactgtgtatgtttccattaaggacccttaaggttcagagtttttgttgaaatacactattcagtcacatggatctgggaggaaaactgaaaccagctggccttgggcagttgctttagaaattctaatacatgttcagtttcctcatgcttcatgtattgaactgtaaaaattctcttttggttaccatcacacaatcacagggcaaattaaatctcatccctgtttcatttgactgggaacaaaaaacaaatcttaaaatttaagagtacttggtacaaccctataattactatacataaatccaaggtttcaggtaccgaatgcttttgttttgagattacagcatcaccgttgttcaggtaaatatgattcatcctgtccagacaattttttgttgttgttctacaggaattcattgacaataataacattctagtttgtggtaggtttcagtatactaggaaaaaaaatcaaccaaccaaccaacccaactcacacttagatggagacatgccagtaatgcgaatattttcaacagagcatattctcactattctttgccttcagaatttaatcagatgatataatagataagtacatgaaagaaggttaaggagaacatcacctcttttttttttcttttgagagggagtctcgctctgtcacctaggctggagtgcagtggcataatctctgctcactgcaacctccgcctcctggtttcaagcaattctcctgcctcagccttctgagtagctgggactacaggtgtgtgccaccacgcccagctaatttttttcttttttgaaatggagtctcgccctgtcacccaggctggagtgcaatggcacgatctcagctcactgcaacctctgcctcccaggttcaagcaattcccctgcctcagcctcctgagtagctgggattacaggcgtgtaccaccacgcctggctaattttttgtatctttagtagagacagggtttcaccatgttatccaggctggtctcgaactcctgacctcgtgatccgcccgccttggcctcccaaagtgctgggattagaggtgtgagccaccgcgcccagccgaacatcacctcttaatctgatgtaagaaaagtaatcaaagttctgatacaaggatagaagtgactgctgcccttcagcctcttgcccctgtgccagctagctcatagttaaaccttggtgcagagagagagagaaagcacctcgtgggctggcattctagtgttctggtctcctgtattctaatggtagtcatggaccctacaaatcccaaggcagaagctgtcttggtgtaaaatagcagcaataaaaattaatttagactgagtcagtactgtaaagaagaaacaaaaatgaaaacaaaatctcacctttcccagctgtgtgaatcaatataaattggttcaacatgagctcttgttagaatctgggtgtttttcacactttgtaatacaaagctcacataggctttacagatgatggttaaaacgtgtgtgttagggtccaataagtgacttctttgcctagcagaaaattcacctcatttattgaacaaaattggcaaaaaatgtttcactctgaatgtttggttattttgactggttcaattaaaaatcacttcttcgtatttgtttatcattgcaaaagaggactggagagttagaacttacatctctaaaagaaggtgtttgatttaatcagaaaagtgactatttggagaacaaggactgggaaagaggtgttaattgcattggagaagagtggcaaggaaactaaaccatttaatttcgaagtctactatcctgtgctcaatccacaagcaggtaaagaatgtaaatttataatttatatgcactgccttctataagtaatgttagagaatcaactcttcagtgatacttgttaaagaccagtaaggaagactttatttaggaccattgcaataggtataggaacagcgggattttgcagtgggcgagagagattgagagggattgcagagagagattgagttcaactccaaaaacagcataggccagtgggaattcatagccaaggagtagtgtgggggtcagcggatggaaaatgagcaagaggaagcatcagcgctctgactgaactgatttaactgagttctttgctcaaattggattttccaaagaaatatgcagataagtctaggagaaggttcagaagccccactgaagtttggccatgcaaagaatctttgtcagtaaatactagtgaaataaatgaaatctgatagagacaaataggatacgacaatctctaatcctgccatgtctttacacctttctcttttgcactgatcctgcttcagttgtgaaactgtgcctggatgtagcgctaacagcacagaagaggtatatgtcaagcctgtcctctttatgcgactgttttacctccctgcgggtgcagaatctttaccttttgagaactgtctttttccttcccaagagtgggcctgccccccaccatcagcaataccttcgagctccaccctgcagccactgtcacaaaggaaggctggggaccttcttgctgttgttggtcccactcttcctccagtcgctgtgtggctaccagcctgagggctcttgctcctggcattacaggacattcaagcccttactaaaataaaactgacattttagcctgtgttttttatgagtatttcagtcttctgaaggtctgatgatccttctcaaggtatcaaataagagagctaataaactaggatgatgcccctctttacttcctgtcctgtaaaccttgaagtcagcacctcccttcatgaatccttgctgctgcgtcgccctctccaagatgctgcctatggcaaactaaatgtgagagatagaaccagaggacaagatagaagaacttcggcggggggtggggggaggagggaggagggaggaatggggagcagggacagcactctggagagtggtccagtgcctccaatgcttcaaagcctggccatcccgtcattgcccagtaaggatgctttttacaggcctggatcatggtcagggacaattctgatagccacaccgacttcctcttcaaaggtcctttttctcaaaagaaaccatttagcctttcagggactgcagtaccgagctctgtgatccagcacagctgacagatgcggaagggggttccagtcaaggaggcttccaaccagtgccctgaggtcaccttgcctggtgattgacacccttgggctccagatagccctccccttccatttcctctgaggaccgctcccttctgaaagccctgggaaactggttttctacttcctttctttttctcattccgtgatgaaatttgtgtggttatatctaatattttgaaacattacaaacaatggggaagagacgaaagatagtgtttcatgggaggtgtatttgagataggcagaagaggaaacaagctttcagccaatgggaaaagtactcctttggccttctatgattgacatttcagaacaagcttttgggagaaagttaaccaataaacactttctaagttactgcctgtattattgaacgtatattgcacttttcgttttcatcttgcacaacctgataggtgagcctgaaattggctctgttaactgttctccattagcttttattcactcttattagggactgcagtctatgtaatgaatttattggatcaattatttgtatcttaatgcatgtttaggacttcaaagacccctttcttttgatttttttcctcatttaaatagttttctgaacatcacagttttggtgccttcactttgatacataattactattctgcaagtgagcttaatacttttaatgccatctgacctcaagattttaatagaattaaatgcaaacaagatgaggaaagaagagtcatggggaaacttgacttgttactgagctttgggaaaaactttaaactcttggtcaaagtgattttctgttaagaaatcaaaaacgtgccagcagatgcctttaaagacaacatttatagaaattatttttttttgagagtttgattttagtattctagcatggatttacgtcatctgatactggatagtataatcttttttcctcatcctctaaccctcaattcttaaaactccgtgaatccatttctttctttgcatttttattattgtgcatcatgagactcatcttcaaaggcaagagccttattattgggaaacaattgtgtagtaaatgcttatttgttatttctctctatagttttttctctatatagtatagtagtatctctattatcttaacacagtcttggaaatacccacagtatttgtaataaatgtataataagtatgtcaaatttattttctatctaaattttgttgttatctcagtcttaaattccatccctcccaaattgctatttctccaccctgaaagataaagggtagcccacgttgatactactcggtgtctgcccaatcacaggaaggcactgagatctttcaatgtactgccatcacatcactaagatgggtgaggtggggatcaaaaattgagagaactaggatggcggcaatattttcaggaatggtcattaataagctagttatgagattgtcatatttaaatttcatgactgtttttcaacctgaatgtatggaaataaaaattataaaccctcttcattttatgaaccttatttttgaatttccctggaatctattgctattaaagccattaattccttactgtaaaacgtcactatcaagaaaaagctaaaaacatcaccatcagtattagagatgcaagcatgcaggtttcctaaactgaagagacattgccccttaatgagcctttacaaaacaagagaagatcatttttgagcttaatattagaaccaaaaagagaaatgcaaggcagtagcccattgcaagaaagaaaacaggaatgcactcagccaggttgcagtcacccccagacaggaaggttcttgccgtttattgcagttgcctctgattcctccctcgaagtctgggagccttaagggtgaacagcctacaaccaagccacgttctcccgacaattctgtaaacctgtttatcacaggcaaattttcaggtgtctgactatagtgggattttttattatcaatgaaatgcatgaagtgacaggccttggttggtgaagtggcttttgtagactgaatatggctgagtatgtacagccaataatacattttaaaaggcatgtttccacgtagctagaattgaatacttggtattactgtccttattttcttctttttactgtatttgataaaatacgtccatgagaattcagcattctctataaaataaaattttgaaggaaagtagaatgaaaaataattaatgatttgatgaggaaaatctaaaagaaatgtgttatttctaggcaggtcctcttggctttccattcaggacttctgcccaaaccatgaaagcaaatgactaggccatatggaaattggttgtaaaagatgttttagattagccagtcactccaggagcctttgatgttatgcaggctaatgaagttggctcttggagaggtttttattcagctgaactgaatttctgagagattcatattacattttcatacagttgtcttgcttcataccccagggatttattaagttataattgaatattgtgtttttaagaaagtttcttaatgtattacacccttcagcaaattttgcttggtattgttttgtcaagataatttaattttacattggctaatttagcccatattaatatttcccctgaaattcaggtaacttagcaaactgttacaggtggtgagaaagaaaactcttttattgaagcattaaaatgttacattattgtgaggtgaaatcttttatcagcctttggagatattctatcaaggtcagtaacattgtatctgtcaaagaaaagttttactccaaaagttgattctcctttcctcagtatcccctgttccctgcattctccagtgttcctccttcctcccatctcttcctgtcccagggaagttctccccggattgctgactggagaaacagcatgacgtggtttctaagtaaggggaaggggggtggggggcggagtactcccttgtcagtggtaacaataggctgtgaataattcagacatgatgaaagaaagtctcatttgacaagatagtacccgattcactaaacagctagtgtggaaataatgatggcgttagttaggggaatacaagaagttcaaaagttttggtggttttgaaagggaatcgcagcacaggggccttcaccagcttcccttctaatgttcgtttgttacgcctggagtttcttacattactgattacgtctcacttgggcgatgttttatctaatttctggaaaggctttgttttataaagtgggcttgcttctgtggaaataaacaaagaccaaatgagaacaaacagaggctatttattcagagcttgctataccaagggagccatcctttgctcttggcagagactcaaaggcagccagaggggtgggaaagcttccaagtgaaagaaggaggcttccagctcactctgattggaggctgttggcctggggaagccggaagtgggcttactagaaagggggcgtgttgtgtggttggtgtggggagcgtatttggcttcctctgattggccttgagttggaaagggttggggagcgaaaatagggacgactcagtcactggccaagtgctgactgttcggtgcccatgactgcagaggttgtgttttggcttcctgggtttctcacgcgggtgggagttgacatacacggtctggccattgtctgtctgcatagtccgcctcactggatactgagaaatttgcctggcagtgtatgaactggataaacttgagtgggaagtctaaaattatgaaggatatttggacagaatacttaatttttttaattcgtaccccacactattcactctttatgaggaacagagtctgataaccacctccacagccaaaatacagaacgtcatctcaaaaaagttctccgtgtcgttcatttgtaaccaactccttccccccaacccctcaccccaaacaaacgctgataggtttgtttgcccctgtaattttgttattttcagaatatcacataaatggctacatgcagtatggagctttttgaacctgagtcccttcacgtggtatagtgcatctgacacatgcatgttgttgcatgttttgaatctgactcctttcacatggcatagtgcgtgtgacacatgcatgttgttgcatgttttgaatctgactcacatggcatagcacgtgtgacacatgtatatcgttttaactctgactcctttcacatggcatagcacgtgtgacacatgcatatctttgatgttttgaccctgactcctttcacatggcatagcacatgtgacatatgtatatcgtggttttaaatctgactcctttcacatggcatagcacatgtgacacatgcatatcattgatgttttgaacctgactcctttcacatggcatagcacatgtgacacatgcatatcattgatgttttgaacctgactcctttcacatggcatagcacctgtgacacatgcatatctttgatgctttgaccctgagtcctttcacatggcatagcacgtgtgacacatgcatatctttgatgttttgaccctgactcctttcacatggcatagcacgtgtgacacatgcataccattgatgttttgaacctgactcctttcacatggcatagcacatgtgacacatgcatatcattgatgttttgaacctgactcctttcacatggcatagcacatgtgacacatgtatatcgttgttttaaatctgactcctttcacatggcattgtgcgtgtgagacatgtgtgtcattgcatgtgtgtcaatagcatcactagtttattccttttttttttttaaagaaaatgctcaactttatatttcatttcaacaatttgctcctaatgcccttttcctgccccaggatcctatctaagaccttgtgcgtgtagtcatgtcttcttggtctcctccaatctgtgaccatttttactctttctgtactgtctacaactttgacccttttgaagagtcctcgtcaggcatctttgggtcgtgtccctatatttgggtgtatctgttgtttcctcatgcttagactggggttatggattttggggaagaatcccacaggggtaaaggacccttttgatgatatcatatcgggggcaccggtcatcaccatgacttattcctggcgatgcgaaccttgaccctttggtgagggtggtgacagttagggttttccactataaagttaccatttttttttccgtatcctattcttgaaaggttttcttttctcaccagctgaatatgtggtgtttttccatactgattctccaactctctgacaccaactgggtgtcctgcaattcaactgaattacaaaaccaactcccagcgttagcacagaccccacacattgagggctcaaaactacccccacttcagatcccaggtgtcctcatatacatctgacagactttgaatcggggttcccaaaaccccctccttgggctcagtaactcactagaacagctcacagaactactcaggaagtcactttacttacttcctttttttgagacaaggtctctctctgtcactcaactcctggtctcaagcgatcctcccttgtcagcctcctgagtagctgggacctaaggtgctaccatgcctggttaattttatttaaaattatttttaatagagatggggtctcactgtgttgcctaggctggtctcaaactcctggcctcaagcagtcctcccactttggcctcccaaagtgctgggactacaggtgtgagtcaccaggcctgaccaggaagtcactttactttctatgaccaatttattataaaggatacaactcaggaatagcgaaattgaggagatgcatagggcaggtgtgggggagggtgcagtactcccaagctctctccaggcgcaaggtgccccgtcctcccagtacctctgtgtgtccaacaccccggaggctcttccaaccccattgctggagggttttcatggaaggttcattatagaagcatgactgattaaatcgttggtcctaggtgattgaactcaaccttcaggccccctcccctcccaggagactggggagtggggctgaaagttccaagtttctaatcaaggcttggtctttctggtgaccagcacccatcctgaagctatctaggggcctgccaagagttgccttgttagaacaaaagactcctataacccttatcactcatgaaattccatacgttttagtagctctgtgccaggaactgggcacaaagaccaaacgtatctttctcattataccacagttccttagaagcaagttgtcaagtccagcccacagtcaagcagagggcagttaagttccactctgcagggaagagtatcaaagaattcgtgggcatatgttaaaaccgccactgtacttaataaatattctgagggatatactttgaggcaatgcaaatatctgtttttcctaaactttcagccacccattttagcattcggcagtggctcttgcttacagcatttctatcgtaatgttctaacggtgatttttctcatttccctcattcttcctacatttgttttttggaatttttctgtaaaggaaatctgtcccatctcccatttatatattcaatcatttatttatatcattttggatatatgaatatttatgttattctctgggttataatcttctatttaggttggtgcaaaaataatggtagtttttgtcattaacactaatgcgaaactgtaattatttttgtaccaacctaatagatttaatttgtaggtcaaatggctcctactgtggccttgagagctttctccagttggccactgtgtttgtttgacgtgctcttatctttttcttttcttggcacttactctgcactgtgagatcctccagccttgttctgtgtgtcacctgcacccgcccagagtcagccatttctttaagaaccctggtgccttttatggggaaataggattagaaaccaagactgaagcatggagtgtgcttgtagcccctgtgctgtcacatcctctaggcctctcagtggacccagctaggaaacaggtatatgtattccaacccatgtatacacacaagtctctgttcctgtctgtatccatctgtatctatttaaaaataaccgtgagtttctacaagtatttctgagtctaatccagtaccatggggttcattctgttttcctcccttggttacttgtaatttatttctctgacagggagaaacctgactcgcattatccacagtttatttaggtgttcaatggtagcatttgtgtaaactacccttaggattgctgacgtgtatcctgcgagaaacaaatttaccaaccaaaatacaggctttacctatggctcatttttcctttatcctgcaataatcagtcaaatcactgtttcccaaggggtttggatcataattctgaaagaaatgctgtaaaatgctgtactttctgaagtctaaatcccaaaagatcaatctctaaatagaaagtgggaatgtttaatagggaatgctcatgttggtggctattgaatcatagaaacatttttaaaagagcagtgctatatagaaaataaatgtgtatgtattttctgaggagagccatgtcctataagaaaaaaagtagctgtgcatcctgatgcatgactttaaagtattagttaatgatggtgaaagccagcgactgtggactgtctccctgcagttacccataatctgtccttgaaatacgcttttatcatatgttgaattttctttttagttttctctgttttttctttttaaatttttttcattattattattattattattattattatttggaggcggaattttgctcttgtcgcccaggctggagtgcagccttagctcattgcaacctccacctcccgggttcaggcgattcttctgcctcagcctcctgagtagctgggactacaggggcatgccaccatgcctggctaattttttgtatttttagcagagacggggtttcaccatgttggccaggctggtctcgaactcctgacctcaggtgatccacccacctgggcctcccaaagtgctgggattacaggtgtgagccactgtgcccaggcttttccccattattttaagttgtccgcattcttttgttttacaatttgctgtgctatatatttccttttcccatcatttccaatactgggggtataaattttgtagagaccttgagagggctctgatttgttttatgtatttttttttcaaatttgactgcacaaaagagcattatcataacgttgactgtttacgcattgtgcatgtttgtaaaaacatggaaaattcctccataaataaagagatgtcttttttgcatatctgcatttgtgaaagataaaatttctcgaggtctcggccatttgggtggctgcatatacagtgatgatccagtgcagtttttgatcaatttcaacagaagactcaggttgtccgtcatggtatttcagatgaccacagttacaaagctgggtgcacacaattaccaaccacagcaatgtgcatgcatacattccccttgttgacctgttacctgtttctttctgaatacagtttgctcatagctcttattcttgtgtgactgtcattagtatacctgaatgtttatccttgcaaaaaatgtatgttattattgttcattttattgcacaaagtgacctatgaagtgttcggtcacgtttttatgtttgccaaataaatctctttttgtacatgtaaataaatgtcttttaaggaattaaaacattttcctcagaataatagttttggaataattttgatctttcaggattgtgatttgggggacttttagacttcagggattttgatcttttgggatttctgcatttggatgtggtgtttgggattgtgtcttttgggatgataaccggctcctggcaaccactgatctgtttctgacttttccgtttttgcctttctcagtaggcaatatcattaggatcatacggcacgtagccatctgggtgtttaacttagcagaaagcatttaagatctatttatgctgttgtgtgaatcaacagttcattccttttaacgctgagtagtgaagtatttcattgtctggaatgtatcacaatttgttgaactcttcatctgttgaagaatgttttggttgttgggatggttatgaattaagctgctatgagcatttgcctacatgtaattttttgggaacttacattttcaattcacttgagttagatacgtaggagtgggtcagataagtatgtgtgtaatttttatgtaaagatttgtaaatattttgtgaatctgtaacagaatgagtagcactttttccaggtgagcgtgtggattgccaagttgcatagagctttttaagttgactgatttttttctaatttcattgaaaaatccagtagttttttttttatcaagccccccctccttttttttttttttttttttgctcttgctgatgatctatttagttattaggtggcaactcatgtcaacaagtgaattcacatgccatttcatcttttcttgccttaacacggtgaaaccccatctctactaaaaatacaaaaacttagccaggcgtggtggtgggcacctgtagtcccagttactcggaaggctgaggcaggagaatggcctgaacccgggaggcggagcttgcagtgagccgagatcatgccactgcactccagcctgggcgacagagtgagactccatctcaaaaaaaaaaaaaataataataataggcctaatcattgtacaaggatgaaggtagggaaaaaaagaaataggaagaagcaaaggcagaaaacatctaggatgctggagcgcagagaacacaggaatgactcaggagttttgatacaagtttgattagagaaaatatgcaagtactgcagtgactaagtagcagattatagttatgaaatcatgcaggacaggaacgctgaggttaaatacaaactgacaacaaaaatcataagaataatatgtaaaagcaagtatgaagcctttgtatttgcttgcgacttgcagtttgaatagcaaaatgatctttcacatcaggctcagtgtgttaaatccagccttaggcaagaataagcaaatattgtttccatatgacaagcctttagctgctagtgaaatgctttctttgtagtgaactgtaggcacaaactatcagcagatgactgtgtatctgagcatatctttaaccacagttagctacaaattatttatagaggttaaataaatgtttacactgaatgattcaggaatgagcacataacagcggtttgggggattatatttctgctattgaaatctaaatactcctacaacaatcctttcagcttagatccgtggtttctagttgaggaagcagtacctcctatgggacattctgggtctcctatgggacgtactgggtgttctgtgggcatttttggtggtcctgatgatggcatttgtggagaggacagaaaacagactgcacctgctgcagcgcttggatagtcctgcaggatgaagggcggctctgcgccctcatagatctcctgcacgaccctctagatgtttacgtaggtaaaagcaaaaaacaacaacaaaaaactagtacttcatttttcttaaacatgcatggtatttttgtggtatttttaactttcaccgatacttgctgcaaatgcaattactgagtaaattgagggaaaattgtgctttggttggttgggtacttttagcgatagccattctccatttcagcaatgcccttgtggtgtttgagcggccagtgcaacacctgtgaatcagtcttcatttgtagctgtggcatgcaaatatttaacagaggggatgtaacattcactgtaatagacttaaaaccaaatatgttttaattagatgaagaccatgaagtgtgaagagaccactgacttttactaatagtttttaaaaaatcactgtcatttatgtagtttttgtttccgtagtatgacagtatgaatatgttataaaatcacacatttaaatgattgatttttgaggttgcctacaggtttttagtcttatgctgatgtgtgcacaagtctacaacataactgtgttctagcctcctggttctttccctcttaagcatcagagactggatcttttgcttggcacgtgataggaattcaagataggagagtaattttctgggatcctttttcagtaccctatcctgtgtcaacataggacattattttgacacttcacttaaaaataagcctccttattcctgagaaagccataaatttctttttctttaataatgagtaatttgtcttggataaactgtctttaataaatttttttgtcttgtcatttacaaataagcatagtcttattttttctaatcttagtacttttgattgtttaatatttcagtttttaaaatcaaggcataacttacatgtagcaaaatacagaagtcttaagcatacaactcgatcatttttttcaacattttattataaacattttcatacgtacagaaaagccaaaagaattgtaaagtgaacatccatatactcaccacctagattctgcaacgaacattttgctatatttacttcatcgcatctatacatcttcatgtccctccattcttccaccagtccatcttatttgatacatttcaaagctgcaggcatcagtacacgttgcccctaaacacttcaccatgcatatcattagagtttcatgtgtttacttgttaagctaaaatttgcacacaataaaatggataaatattaaacataaaatattgaacataaaacacatatttttattattcctttcacatgagattcatagatgccagaataacagttacctttttaggggtggtggtaagaatgcaaatattttatatctctatctaggtggtgttttcatgagtgtatagtttaaaattcattcatgacatattcatacattagaatagtatttactgataataagcaacaaactaacatataaatgctcctcacatgattttacgaatgtatgcatccgtgtcctataagtccattaaggtatgaaatatcactgccactgttacctcagacagttctctcatgccccttcccagtcaaacctaaccctaacccaaaaggaaaccacaattttgaaaatttttgccatagaaaatacagccttggtatggggatttgtggatggtctggaaacccttcaggggaccctgggggtcaaagctatgagtagtattgttataatactcgtatttttataattctactttggcattttcccttttctatctcattctgttgtgaatggggattttcagatgctacagtaatttcttgcattgtaatatttttgctcctaggttctgtatttaagggagattgatgagctgaggaaagaatgaatgctttaaaacttgatctaaggcggtattctccatcctactggacaaaataccccccttttttacaacaaatatttaatcatggccctattattctcctgcgatgcaattcatagattaaaataaccatcctaggccgggcacagtgactcatgcctgtaatcccaacactttgggaggccgaggcgggtggatcacctgagctcaggagttcgagaccagcctgaccaacatggtgaaatcccgcctctactaataatacaaaaattagctgggcatggtggcccttgtaatcccagctaattgggaggctgaggcaagagaattgctggaatccgagaagcagaggttgcagcgagcagggattgcgccaccgcactctagcctgggcgacagagtgagactctgtctcaaaaaataaaaaaatctaaaaaaaaataatcatcctaaacatacaatttaaaaaaaatcaatataatattctagctttgatataaaggagacataaaagtaattcataatgaatatgtattttaatatgtaaattgaattcagaaacagataggaaaatccagctgtcttttattaagctaaacattaaaggcatttttaaaaataaaaagtgccatacttttactttgttttggaaagtattatttttcataaaacatgttatatagtctaatatgtaaggtttattgtcatttttaatgaattatgaatctcaagtatctcagtataaaatgtaatatggtaagtgtacatatataacaacataaaacaaaactttttggttttcttttaataattatagtttttaaactgtataaggatactgagagcaaaaaatttgagaatcactggtttagcttgtactagaacaatataagtgaattatatagtgtgtggctttaaaaaaaaatctagtgcttattttactcaggataatgtttctgagatgcatccatatattagtagtttgttccttattatcaataaacagtattccattgtatgaatataccaccaatgaattttaaaatatatgcccatgaaaataccatccagatagggaaatacagtatttgcatccttaccaccttgcccctaaaggtgactgttattctccatctaagaatctcacatgcaaggaaacagagtttgttcttttatgtctgacttccttggctcaacgttatgcttgtaagattcacctgcgctgtggtgaatggtttgttttctttccttttaacgctagttctcgttgtagtgtccacctgtatctgtgctcttttgttctcctgtattttcacatggaatagcttttaatcttctactatttctacatccagacatactcattatacgaaggtggaagtatctaacaacttcattatgctttcagtgtagtcagccatcagaatttacatattgaaatgcaaagtcattatgaattgccttctttggtttctcctttacatcactgttagggcattatattgattttttttaaaaattctatgtaaaaggctggctgttttatctggattctatttcaggggattaaaggaggcattattaaatattagctgttaaaaagcaagggaatattgagtccagcaggattcagactacctccttagatcatgttttagagtatttattcccttctgatgtcaccatcctccatgagatacagaacctaggagcaataacattgtaatacaaagaattgatcacttgcttcacaagaacatgcttttaataagtgtatcatttattttacaaatggcgttttcccaagagatgacatttctggccggttgaccaaaatttttggtgatgagtagaaacttcatgtttgaggattgacatcttgaattttttgtgcaaaatttgaatattaatttatagaggacattattcttatctccacagtatctcatttgcattagttaatattaaataagtaaagtagttgtccatttttctcagtcttaacactttctaaattcatgcctcaagaagttcttttattccaagaaaatgatccaaacgttattaattgcaaagtgtactcacttatttttcacttcggggaaaaaagcagaatgataactaaaaatgaggtctctgaagttagactaccttgatttttaatccagctcccctacaccagtcacttccttgtatgcctcagttttcttatctagcaaatggggtaattgtacctacttaatactactaagtgtacctggttaatatggtttttgtagttattagagggaataatataacgtgagatacttagagcagtacttttagtaaggatttagtaaataagctttagtaaggacatgcaagatctgtaaagaatagcttttggttattatgggctattatgacttcagaaataataaatataaagctaatattaatactagctgttacaactttagaaataggaacaaatgatgagattagggcttgttcctttgaattttttggaattagttttcttagcagtcaacaagtatatatggactattagatgtggatactttggaattaaagatataaatgagtaattaatactccttagagtgagctcatggcattgtcactttaacaatatgcccaaaagtggttctatttaaattccacacaagagaagtagcaatgttatatagagcattgggttttcgtagctatttggatttggaaattaggagcatattagtaatcttagtaggacaagccagaggaatgaagagctaggaaggaagtagggattgtgtatccagctgggagaagtttgaatgagcatggaatagaatgggcatcttggaggagatccttctctaaggcatctagaggagaaggcagtgaacttcacacactggagggctgactcctggaggtgactatggagggaggggtgggccctcaggtagagtcagaagaccactcgtggctgcagagggacacttggactctgggactgcctttggtgagttgacccagggactaaggggagaaagtttgaaattgtgtctaaggggattgagcaaagcagcctgggaatgtgtaaaaaagaacacacaaataaacaaaaaagtgccgagtggtcctgaaagcccacgggatgagacagtttacagtgtgagaacatggtaaggcttttaaaaaaattgttttttctctttcatatttttcttgtaattgcttattttaacacaaaatgaaattcatgatagctaacacttacataggcttactctatgccaggcactgatctggtgtaaatactttacatgtgccagctcattccattctcccactaattttcagagctaggtaatatccttctcatcactttacagatgaagaaacagaagcactgagacatgaggtaatgtagttaggaggggaaaatagaatctgaacccaggctgtctgaatcccaagtctgtgttcttaattatctaatgatggtattttgcctcaaaaaacaaacaaacaaaaaacaacttaggaatcatttggaaggaaacaaaaaaaatagcacaacaaagtattatgcaggtcattgattatcataaaatgactgtctcccaaagcaaggagagatgattattgaacacttactttgagccagttactatcttaagccatttactttaccatccccattttaatcctcataactctaatacgtaggtgctgttactttcatccctgttcacacatgtggaaagcagcagggcattaatctttctaaggccacacagccaataagaggcaaaagcatggcacaatcccaggctcttgattgtcttagggatggtcattaacgtgccatttattattctggttggtagtttagcaaccagctttctaattgcatttactattctctttaaagcagcgttgaatataatagactgcaaccatacttctcctctaccacctaagttgcaacagaaaaactgttgctttgaaggatgtgcaagagcatagacatggcccgcataaagcagagtgtgaaggtccccaaaactcaaggacagtattgtcatggataaatacagccgattgagcatgctgatgaaatgttgcattatcatcttgaaccttaaactttaaggaaaataaataaaaatcagtaacttcaaagagcatttcattaaatagacaagtctttattattaagccctcagcatttctcagctcagcagcagttcctgagactgtgtctgataatctgaatggatagtgcaggcatgtgctttacatttggaatgtcttagaattgcttcttggaagctccagtgccaccagctgactggaataaattacacgcctagtctcacatattgtcagaagttttcacgtgtgcatcgggtacagcctaaaggtttggcacagagctgtaggtacacgtttatgctcaacactgagaaattgaccagaaatagtcaccaatgcttcacactttctgaaactcccacgtgtattcctctgaagtccctttctcattctaccctctccatgacccaaattgtcattttccattcagttttccttccccactcctttagatcctgtttggtagacttgccgtaggaacacagaacaaaatgaaacattttcttatgaatattcgtaaatttctgatggtcttgccctgttaagaccaaaatctataggtgtgccgggtgacatctgtaaaatggttgtaattatgccacgttctcttggtgccctaaaacctttgttgaattttttacagtagagctttttaaataagactttttatttggaaacaattattgaattgcatgcacttttaagaagtaatacagagagatcccatggacccctttacctagtttcccacaatggtgattgtctttgtccatttcctgttgcttagaatacctgaagctgggtaatgtatgaagaaaaagaatgtatttcttaacagctgtggaggctgaaaggtccaagatcaagggtctgcatttggttagagcccttttgttggtggggactctcttcagagtcctgaggtgtagtacagggcagtatatagtgagggggactgagcctggaacctcaggtctctcttcttacaaagccacaagtcccactcctatgataaccctttaatccatccactcattaatatattaatccatggatagattaatccactcatgaggtcagagtccttatgatccaattgcccctaagctcccatctctcaatactatcacattgggtattaattaaatttcaatatgactttcggagggggcacatattcaagccatagcggtgacatcttgcagaattgcactggaatatcaggaccaggatatggacattgataaaatctaccatgtcagtgggactcctgttcaactcagatgagggatgagcctgcctggactgccttctatggtaggttaggggttaggagttaccaggcctggcttactttctgctgttggtgagggaaggaaggtaacgttctttgttgcgatcttcctccagtcctggggtccctagccagttttcctgcttgttcacaataggtactaattgatgctcagctgaaagtcaaacactcagattttctcagtgttatttgtacttattgtctgtgtgtgtgtgtgtgtgtgtgtgtgtgtgtgtatttacggctatgtaattttaccacatgtgtaagttcacatatccctactacagtctccattcatggagaataggttactggttatgaggagtgagggagatgagacagggccgaaagtggtgaatgtatttataaaagggcaacagaagggatccttgcggtgatggaactgttctgtatctggactgtatccgtttctataattatgtcatttcaagaatattctctaaatggagtcatacaatatgtaaccatttgagattatttttccctctcagtgtaattcccttaaagtccatacaaatggctatacgtattaataactcattcatttgtattgctaagtaatgggtcatggtatggatgtaccacagtttgtttcgccattcacctattgaaggacacctgggatatttacagttttgggcttctgtgaacattcatgcacaggtttttacataaacataagttttcatttatctgagataaaaatctcagagtatagttgctgcgttgtgtggtagctatatgtttagtttcctaagaaattgtaaaattgctttccagagtgcctgtagcattttacattctcaccagcaacgtctgagtggagtagagaggcttcccagcctgggcacttgttgtggagagattcccccttgctgtggctgcccagctgccttgtgtgtgttggtgagaaaggagtctcatgtctagtggggaaggaacatccttctgtctcctgattctcagtgggctgccagttggttgatcccttgcctgtgctgccaggcttaccttctgttgtcagtgggactcctgttcagctcaggtaagggatgagcctgcctggactgccttctatgataggttaggggttaggagttacgaggcctggcttagtttcttctgttggtgagggaaggaaggtaacattctttgttgccatcttcctccagtcctggggtccctagccagttttcctgcttattcacaataggcaggtattgttgctcatgagcctctgaattggctgggtgttttttctggtcttggctttgtttgtcccttgcactaattgatgctcagctgaaagtcaaataggtggctctgctgatctggactgagctgcctcacatgtttggagatcaactggctatgggctcatctagcatggcctcagcttgcacagtcatgctcttctctctgtggtctctgattcttcagcaagcccacctgggcttgtgcacatgatggttgcagggatccaggatagtgtggaagtgcacaagccctcttggaattggagcttggagttggcaagccatcacctcacttgcgtcgagtgaaccaaagcaagtcacaggatcagcccagagtcaagaggagaggaaaggacgtgcttcctgaaggcaggaatttcacattcatattgcaaagagcagaggtacaggggagcataaagaatcgaggccgtttttataataaacttaactcaccctcattgttgtgcatatgtatgactgagttcatctcttggggttctgaatacctttaacctgtctgtactttggttacagggactgacatctgagtcatttctctttgattcataggatggatttaatttttgaagccatccatcatggaaagaatatgctttgtcttctcagaaattgttatttttttccagattatttcttgacatgtttctgcatttttcaaatgtccttttaaaagtatgtagctttgttttccaatttttttttactgtggtaaaatacagataatcaaaaatttactgtcttaaccatatttgaatgtatacttcactgccattgagtacgttcatattgttgtacaaccatcaccccccatccatctccagaactcttttcatcttgcagaactgaaatgctaatccattaaacaataactcctaattcccttcttccttgagcccttggctggcacccttctactttttgtcttatgagtttgtctactccgtgtacttcatataaatgggatcatacagtatttctcattttgtgactggcttctttcacctaatgtaatgtcctcaaaatttgtttgtactgaagcctgtgtcagactttccttcctttttatggctgactgataaagagggacctgcttccgtcatgttgctattctttttcctatatgtcttatcacttttttggttttccatttcctgcatttgtctgcttttgtgtttagttgattttgtgtagtgacatgtttgaatttttttcttttttttttatattctacgtctgtttttcttgtagttactatgcagatgacatttggtatcctaaagtcaaatactcttaatttggatttatatcagctgaacttcaatattatacaaagtgctgctcttttatatcttcattcccactgttttcagttgttgatgtcacaaaatcacatacacgatacttccaaaaacatcaataatttttaaaaatgcattagccttttaaataacatagaaatcaaaatgtggggttaaaaaccaaagttacaatgatactagcttttagactaataattgcttttaaaaaaagtattagcatcttaaatcatatagaaaaaagtggagttacaaactagtgctaaaataatactagcttttacaattgcttatgtatttacctttactgaaatctttatttcttcatacagctccaagttactatccagtatcttttcatttcattcagaagggctccttttagcattttttgcagagcagtctacaggtaacaaactccctcaacttttgtttatctgggaaatcttaattccaccctcacatctgaagtcccattttcctagctgtaggattcttggttacagggttttgtttttgttttttcaaattttctgataacaaatctgctgataattttattgaggatcccatgtatcgtgatgaatcactgcagtttcactgatttcaagattctgtctttgtatttggctgtgggaagtttaattacaacgtgtctcaatgtggatatcttaaagttcttcctacttagagattgttaaacttcttagatgtttgtattcacatctttcctcaaatttgggaagttttcagcccttatttcttcaagtatactttctgttctttctccctctcttctttttctaggactcccataacacatatgtttgtcctctttattgtgtccctcaagtcccttttgctctgttcacttttcttcaatcttttttctttctattcctgagaatattttcctttgccctatcttcacattcactgattctttcttccacctcattaaaattgcttttgaatccctctagtaaatttatcacttcagtttttttttctgctccagaatttctttttggtttcttttttggttttctgtctttatttatatttccattttgttcaaacgttgttttcttggctttctccacatctgcctttatttctttgagcatcttcaagacagttgttttaaagtctctgtccagtatattagccatcagggctttttcagggacagttactgttgttttattttttttctttaaatgagtgatactttcttatttctttgtatgccttgtgattttttgttgttgttggaaagtggacttttgaatctaatgaggtaatatggaaatcagatttcccccttacccaaagtttgctgtttttgttttttgttttgctggttgttgtaggctgtttctgtgccatggatcagcctaaggtgtatacttaagttcttctcaggtcttttctgagcctctgccttttgctgggcatgcacaggcacttcctaattttcctcatatatgcagttgcttttgaatatcctaatcttcaatgtctgcttcctaaaagaagagaaagagaaaaattaggggataaaagaatactggcctttggccaggcacggtggctcatgcctgtaatcccagcactttgggaggccaaggtgggtggatcacgaggtcaggagatcgagatcatcctggctaacatggtgaaaccctgtctctactaaaaatacaaaaaaattagccaggcatggtggcgggtgcctgtagtcctagttacttgggaggctgaggcaggagaatggcgtgaacccaggaggcggaggttgcagtgagccaagatagcgccactgcactccagcctgggcgacagagcgagactccatctcaaaaaaaaaaaaaaaaaaagaatactggccttttaaatctcatggaagtcactttaggtggttggtagaggcctacaacagtgggggaaggtgcagcaacagcggccactggcctctttgtctgcacctctgtgatcaaaagcagcaatcagtgataagaacagatgtcttgtgtttggaggacagtgtcctttttgcctaccaaggctcctgcaaaccgtatgccaagctgctccaggaacatgtgcacagctgcctgccatgggactggggcatgggataggtagctctattatgccaagagctgaaattaactgaaaataacttcaatttactgtccaagccttcttctggaagttggaagccttaagtagcctccagagttccaaaatagttatactggacagattctgccagtgcaattgttgtccaggtgagaatacagactcctggttctctctcctctgccatcttcccagaatcatcctctgtatcatttttataatctgaaaaaaatagttgtggaatttggaggtatttttctaggttttatgatcttctcctgaatgttactctttgtccagccttataaatttttggtattattatccagacaaccatgatcctacaagtctgacaaaccatgctgtgactacttctaattgggactgttaaattatcacactcatgcattcctgtgagggaagccttttgcttctatggtgggtcctctgtggaaggtgcgtctgccggggacctgtgaaggctgggcagtgccccagggaactgtgaaggctggacagtgctcggcgctgatcgatggcagggtcagctttttgagagccctgtttgtgttgtcccactcctgttcctggagaaaatcacctttacaaaggctcaactggcaattttggaattacttgggtcattgttctgaatgtgctattggttttcagtaaataaagttcaaattagaagcttagaaatagtttaaggtgtttggtttttgagctcctaatagtctttcttcactattttggccctcttggtttctattaagttggaccatatgtaattgtcattttgtaagtcaaaagcaatggaatagtggcaactgcctatggttcaacctaatactttacattttacctgtagcagattgtggctttgttttgttgccttctcaactttcaaagaaagcctttttttttattttatttttttttttctatttgaaggctgtttcccagaccagatgtatctccagctctgacacatatgtgcttgactggtcattcacactgatgtttctaaatcagcctttcataacatttttatttattagtacctctttttttttcttttttttttttgagacagagtcttgctctgtcgcccaggccggactgcggactgcagtggcgtaatctcggctcactccaagctctgcttcccgggttcacgccattctcctgcctcagcctcccgagtagctgggactacaggcgcccgccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcctagtacctctttaaatgaaaaaattatttgataaagtcttgactgtctttcccacagttgtttgtgaccagtatttgcactgattctcgaaacgagtgaatcttccaccagtccctaactgtgatcctaatcacgtgtaacgtatttcccaccctgcattgtccacaggattcttcattcatcacctaccacgcatcaaagtgccagacactggagtcagaaatatgatagcaactcatgtatgctgtgtgatcagtaactatctgttgaatgaatacatgactgagtgtaagttaatgaacgaatgagtagcatttgctttggaggagctgtctgtcttcagaagagagaaacttgtaagcagacattgtcaatttggtgtgcaaaggacaatcatagatgtgtatgcaaagggccatgggaacactgcagagatgttagtttttcatatgcactgtacccacattctgtttcccagttgcacggtgaaaatctattctgtcagatttgtgttttgatcacttaaggcttctgttactatcacctgaacaaattatgcagatttctcaatcacatttgacatttctggttcaatattatgaacccgatcagatcccattgttgtgtaacattttctggatatatgtcttcgtcacctatctcacaggtttgttgtgaggcgtaaatgaagatagtatgtgaatatgtataaaccactatgcagaaaacatggaggttaagctgtcactctggatgatagttgttcatcactgcctacagtaactgacctataaaacaaccactaggaaaaagaaaagaagatattttgctttttttttttttctggaagaaatacagtagatactcaaattgcctgccaatagaatagtttcctggacaaggatgaatctagaaaggacatttaacagagattgaccttggttttgttacagtgacctgagaatgtcagtcagtagtcttgcataaccaccatatagtgaaacttctcaaaatctccatggtaacatgcagagaactgtatcatagagcacggtgtatacccacacggactgtgatccaggaagaaagatctgtttccacccccacacacacttgctcacgttcacctctcttctgccccagcgcctcagatacctgcttcctcactggtaattgtgatgatatttttctctaaaatctattttgtaactcattctttctgattttactctcaacccccttggcgcttacattggatgagataaaagtgtcactgtagggctgtaaactttgttgtgatgaagactcttgagacgtaaaatgtatgctctaactgcagacctgtgcagaacgcgagtttgatcttcaagtgactttcgttccagccttgatattcagatgcagtgcactaatttgcccttattggcatcctgtttaatagatattcctaagcctttttccaaatagttgcatgtttgaggaagactttatggctatcaaagtgtttactcatataatccagtttgatcctcaccttgtgagatcgtcagggccggtaggatggttgtcattttacagatgaggagacattttctgatgggaattagccaacctgtggctgagctggaaccagaacccaggcctgtgtccttgtactcaggttgccacagcattcctcctgatgtgcccagcagcaggcttctaaaggacctgagccccctctgccaacagtgtcccctcttagctactggtgtgatatgtagctgtgagtccagggtgggtattcacatattttcgattgaccaccagcttaaaacttcccatgccacaccacactgcccatctatatattactttgcaatcattatcataagcttaaaacttcccatgccacaccacactgcacatgtatatattactttgcaatcattatcataagcttagagactttacagaaagtcgtccttaaagtgttgctaaaaaatataggtcaattacaaaaggagacatggtccttttcttttttcttctcccctaattataaacaataaaagccacagcttcatgctgagaaaggatcagcagggaatgatggacattgtgatttggcagctgacattttctaacatgattttgttttacataagtagtttgaagtttttgttggttattgtcttgccttcctttctgacaaagtaacattttttttgcccataaaaatcaagtagagcaatgcatttcccatgccgtcgtgtctcccatcttgtagcaaccagtagtgtataaaatgaaagtcttcccacctttaagcaaatgtttgttttccttattaagaaagaagtttcatttgaagctggaggtttttttttcctaacttatattagtccatattttaatagtagtttcctaaagaaaatatctcagcatgaaaaagcaaggtgatactatattttagaaaatgccctcatggcttagattttaaaactaatgcttttgttaagtgttttggctttgaacaaaaagcctccttgagaaacgctatttcccattgcacggtttcttaactctctgggttaaagttcgtattttctatctttttacatctggcaaatagacccagagaatgtttttgtttcatctaacagttatttctacagatctgaccaggctgcctgcacacatctatatttttacactgacagcataagtgtatgttttgtatttcattgtagcgaaagcacttcacgtatgcttatagtaggttgaagtatttttagatcaaacgtgaatccaccatgttccgtaaactaaaatatatttaatcttaacagagtatacttggcggaatggctgactttaaacataagcttaaacaaaatgatgagttcataattatttaatgtaaactgaataaggttgaagggccctgcagggtcgatttcaaagtgcttcaatgattacaaattatagaccgcctttccagtaaaacactactcaggtgggagactagctggcagcactataaagtacctaaatggtttcagactaaagaatctgttagttttgtaggtttaacatccttgacacttaataggatttgagattccattgtagcagcagcttttattgcatgacactttaattgaatgccttagagtaaaatgaaattaacaaaggcagtattaaattatggatgttccttttttatcatttggctaagaattctgcggagtttcttttctgattatattattttaaattgattgatgtgaaaaaataaacacactatctttaggactaggtataccatctggtccaagaaattgtgaataaaatgaatacagagctggagttggccaacttgtctctcctacgcttcagaaagcaattacgttagggctagagtagtttaaaaatggcctgcaataaatccccattcttgagtggataagagcaaggcagctccgtcttttgcattgtagctaccagaatgacaacgtattctgagacagatgggagacatcgaacagtagttgatttttgtttgtgaagtggtgtggcaaagccagtaacctattttttttaaaaaaaaaaaacaaggacaaatttaaccaaatctgacctgtttatatttaaacatcggtgattggaaaaccgttttcatatttggatattgacgatctttatattgcttctccttttctctaatactatttaaaataagaatctgcaactaaactaaaatattcaaaaaataataaagttaagatgatgagtccgggcgcggtggctcacgcctgtaatcccagcactttgggaggccgaggcgggtggatcatgaggtcaggagatcgagaccatcctggctaacaaggtgaaaccccgtctctactggaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagggagactccgtctcaaaaaaaaaaaaaaaaaaaaaaagatgatgagcatgatgtcagcaagatagtggaatcagaagcctcagtctctactcccctgacccccacacaccaaaaggtgaacttgcagctgtccacagactagaatatctttttgaaaatgtcaacacttggaaacgagcctgagatacctgtgtgatctgcataattcaatgaaatctgaattaggagagtgagaagaatggtctcactctgaccacactgccccttcccatctcccaagttggcacagtgccagactgagaggatttccctggaccaacagtttctgccacagggaaagagaaccagaggcagtcatctagtgatgctaacgttccaggatgcttcacaagaagcccactctggtctcacctcttaggaaacactaggagaaacagcatggccacagtgcctagggtcaggtagaaacaaagaaaggaggcagaggtcatggttaccagcacatggatcttagaggtacctctgtgtttctggcagctgtggctcccaatagcagataccagtcaacttcataacccacatttaaagctaagctggttgccttcattaacgtggtaggaatttctacctagcctgagttcctagaatgctattctccctggctagcttcagagcccacccaacaagcctgcacaggcaggaagacattcacctcctcccatttcagggaagcaaaggggctagatcagcttgacccagaaagtcgagctgtggctccacctagctagaaagcccacccaaccaccctgtgcaggcagagactcccacctcctggcattttggataaatgcaggggctagtcttgcttgatctagaaagtcaagcagcagcactactcagccaaaaagcctgcccaatgaccccaccctagccaggagactcccagctccacagatttcagagaaatgaaggggttagatcagctttacctaggaaggcaagcagtagttccactcagcccaaaagcccacccagtgacccgacgtaagcagggagactcccaccttcatggatttcagaaaagcatagaggctagacctgcctgaccaggaggtcaaacagtcactcaactcagtcaaaagcccacctcatagctccaccctgacagggaggaaatcctgaatcatgaatttcctaaggaacatagcctctggtctgcttgtcccaagcaatgactttgctaacctcagagaacagcctatagccctgcccaactgtagatctcaatagtggccaaggaatacatcctgtaactggcctgaccagaagtcattgcagtacttagccagcaatctcatcaaacagggaagccaggcccacaaccccacctgacatcagagcaaaagcagcagcccaactaagttgtgaactctcatgaagctctgcctgcccaggattatcaccagatggcccttccagaatcacagtctagattagatagtggaaatctattcctgtcaaagaacacctgtaaaggccagaaaaggggactgtcttctcaaatgtgcagataacacaaggattacaatgactcaagggaatcatgacacctgcaaagaaaactaataaagcttcaatagtagaccccaaagaaatggagatctgtaaaactgttgacaaagaattcagaatagtactcataaagaagttcagtgaactacaagaatctatggatagaaaattgaataaaatttggaaaacagtacacaaagaaagcaagaaatttgaccaaaaatagaaacaataaaaaaaaacaaatcttagagatgaaaaatacagtggctgagttgaaaaattcaatagaaagcttcagcagaagacactgtcgagcagaagaaagaattagtgatctggaagacagaacatttgaaataatccagaagagcaaaaagataaaagaatgataaagaatgaagaaagcctatgagagttatgaacactgtcaagagatgacacctttgtataatgtgaattaaggacagcagagagaaaaaagcaccagaaactatatttaaagaaataatagctgaaaacttttctaatataggaacagatgccaatacccatgttttaggctgttgttgcattgctgtaaaggaatacccaagactgggtaatttatgaggaaaagatgtttcatgggctcatggttctgcagacagtacaggaagcatggtgccagcatgtgcttctggtgagggcctcaggaagcttacaatcctggcagaaggcaaaggggaagcacttgtctcacatcgctagagcaggaacaagaggtgatgggaaaaggtctccaactccttctaacaaccagatcttgtgtgaactcattaccatggggagagcagcaagccactcatgagggatctgtccccatgacccacacacctcccatcaggcctcacctccaagaacgtggatcacagtttaccgtgagattgagaggataaatgtgaaatcatatcaacccaagtacaggaagcagagttctccaatcaaattcaacccatagaagagtttaccaaggcacatagtaatacaattatcaaaaatcaaagacaaaaattccgagagcagcaagagataagaaacacttcgtatacaaaggagtaccaatactaccatcagtggatttctcagcagaagccatgcagacactgaaagaacaagatggtatattcaaagtgctgaatttatatttatattttacaataaagtgttgaatatgtaacgcaagggtatcatactgcatattagtagttgagaaaaatattaaaattcaaaatttgaatttaatatgtattgcttttgcattattgtaaagttgaaaaattctaagttgaacttttataagtcaggaattgtctgtacttccaaaaatctttttacaaagccaacattaccttggtaccaaagccaaacaagaacattataagaaagagagttaaaggtcagtgttcttgatgaacatagatgcagatttctcaacaaaatactaacaaactgaattcaacaacacattaaagggatcattcatcatgatcaagtgggatttattcttcgatacaaggatggttcaccatacacaaatcaataaatgtgatatatcacattaatggaatgaaggacaaaagccatgtgctcattttgttagatgccgaaaaagcatttgacaaaaattcatctttttataaaaattctcggcaaattagttgtagaaggagtggacttcaacacaacaaaggccgtgtgagagaatcccacaattaaaattatactcagtggtgaaaaattgaaagcctttcctctgacatagacaaacatgcctattcttgccacttatatttaacatagcattggaagtcctcaccagagtagttaggcaagaaaaataaatagaaggcatcgtaataggaaaggaagagctgaagttgtcactgtttgctgataacatgatcttatatatatagaaaatgctacagaccccaccaaaaaaaaaaaaccctgttggaactaataaacgaatatattacagttgcaggatacaaaatcaacacacaaaaatcagtggcatttctatatgcaaacaatgaactatctaaaaggttatcaagggaacaatttcatttacaacagctacgaaaattacttaggaataagttcaaacaaaggagtgaagacctttacactgaaaactagaaaatgttgataaaaaagttgaagatacaaataaatggaaaaatattttatgttgatggattggaagaattaatattgttaaatggccatactaccaaaaccaaccctaccaattcagtgcagttcttatcaaaactacatcatttttcataggaatagaagaaacaattctaaaatttatgtagaaacaaaaatacccccaaatagccaaggcaatcatgagcaaaagaataaagctgaaggcatcacactacctggtttcaaactatactacagagctatagtaattaaaacagcatgggactggctgaaacagatcaacagatgaaacagactagagaccccagaaatgaacccatgcatatgatttaaatttattttctttttcttttttcttttctttgttttttttttttggttagagaaagggtctccctatattgcccaggctagtctcaaactcctggcctgaaatgactcatccctgagcctgtcaaagtgttggtattacaggcatgacccccatgcctggcctattcaactgattttcaacaaagatattatgccaagaatatgcaataagaaaaggatatccccttcaataaatgactttgggaaaagtagatatccatacacaaaagaatgaagttagattcttacttcacaccatatattaatataaaaatcaactcaaaatggattaaagtcttaaatataagatgagaaactataaaactaatctacagagtaagaaaaaatatttagaaaccatactttggataaggggttaatatccaaaatatataagaagctcaaacaactcaatagaaagaatacaaaaaattctaattaaaaaaatggacaagggactggaatagacatttctcaaaagaagacatacaaatggctgacagatacatgaagaaatggtcacatcagaaatcactaaggaaatgcaaattgaaatcacaatgagaaactacatctcacacctgtcagaatagctgttttcaaaaagacaatataacatgtgttggccaggatgtgaaggaaagggaaccctgttggtggaaatgtaaattagtgcagccattgtggaaaactatgtggagattcctcaaaaaaaatgagaaatagaactgccatatgatctggcaatcccacctctgggcatttaccgaaaagatttgaaatcagtgtgttgaagacgtgtgcacaccaatgtttactgcagcattattcacagtagctgagctgtggaatcagcctaagagtccatcagcagataactgggtaaagaaaacgtggtacttacacgtaatggaatactattcatccttaaaaatgaaggaaatgctttcatttgcagcagcatggatggaatcagagagcgttatcctcagtgaaagaagccaggcacagaaagacaaatatcacacaatctcactcatctgtgaatctgaaacaataactcatagcagcagagagtaaaataatggttatcgaggctggagggtggggggaatagggaggtgatggtccaagagttaaaagatctcaggcaagaggaattttttttttagttttgttgctgagcatggtgaatatagttaataatagagaattgtacacttcaaagtgtctgagagtaaattttaaaagttctcaccataagaatcattaaatatgtgagctgatggatatgttaacgagattgatttaattattccacattttattaatcaatcataacattactttgtaccccatacatttatgcaattgtgaattgtcaatttacaattaaaaagtattttcaaagattttaaaaagtggaggctggactgcttaggacatgtgaaaacagaagacaaaatataagaaaacattacaaattaaataattattttcttaacagactattggtgtaaatgctttataagtaactgtctactggatggaaagggggaagaaatttgaacatatctggtaaattacttagtaaatttaggcatttatttaaaaaaaaatacacttgctcatgattataagacttctgagctcagattgtgagtgtgaggaaagaggagacagcctcttaaaaaggtcccaagcatgacagatgcagatcttggttgagagttgttgcttctgctgtcagtcacatcatcatcctgttaaatgtgaatttatcttttttcccctatgcaaaatagtgagagaaatattccttgaggaaatgtggtctttatttcaaattaacagttttagcgattgcttgcttttattaggtcatgcatcttgttttctggatttgtcatataatgcagttgtgctcgtgtaggtaacacaaatgtggtctctttgaacatagaagctgggattgcagtgaaatagagagagcgaaagtgctctccttaagtcctccttgtttgttctctttcttttgggttctgtctgttaatttatctcttttactctttcccttcttccttccatccttgtcaaaagcatttatgtactggacagaagcatgtcttggatgacttaaagtgcagccctgttttgtagttattatcttcctgcataataagtaatctctgttttccacttgttgcagagttaaacacagctttctagtgaatcctcaccctagagtagaggaatacgtgatattaattgaaatagacttcctacagggcattttgtagcttttctcctctttctcacttaaaaaacataccagatagttttgtgttcaggaccttaaatcctagcctagcaacggtcatacattgtgaaacaaataatgagagagaaggttatagttaatactcttataagcctctccatgtacaagaatacagacaaaaatgcaaagaacagcactggatgtcttctgattaatcaaattatttctgtgtctcagtgaatggactgaaatacagtacagcctatttgccttaataccgatgaatttttatacagtgagtacgttctctggtctttttctcgctgatgaaatggatgtttgtgttagggctagagggagaaaagaggcgtgatttaactgttacctgtgcctgtgctttacagttttcctttttaaaacaagttttgaggaatacacctcggtagtactactgtacagctggcaccctacaactccctttggctcctgcagctcccccacacccccaccaacacactaatccatataaaagtcatattactggagctccacctcatctttttcagatatcaaagcaaatagaagaaatagagtataaacattgttctcttactctgacaagcagaattgatagacatctttccccatacactttagtggtggttgacataaacattgtttttgttttcaggttggaaataggaaatgagacttgacaatatattcgtgtcactaaaattctttattccagaaaagacttagtattgaaatcacacacacacacacacacacacacacacacacacacacactcccatacagaaaacttttctcagtggactattgccgttagtctttctcctttttcccacctaattacctgacattgtttgaaagataattataattgacaaaattattttttctatacataagcatctaaactctgattaactcaggaaaacacaaagaaaatagttacttcatttgcagaaaagcaaaggtgacagagcgtagcaacatgatgcagctgatcacactggagccttgtgcacacgctgtgttcctcccatttgagcttaccctagagatgaacctgtgtaaaaagaggtaaataccaacaggaactgagagcaattctagaaaaactaatggcattggttaaaaaaaaaatcccttctcctcaatttctgtgtctaagtgattcctaaagtaccattttataaatacgaagtatcattcctctggaagaccattcctttttgtttttttcagctggcccgagccctacctgtcctttccttataaaatactggccaggtcatcagaaaacagttaactcagagatgctctctaaaaaactctctgaagttgacctgcatggcagaagtgtagcaagtcaactctctctgctgtccctcacctgttctgtagctttgtgaagtcctgcatgaaagcatttcaacataagacgtggtttcattggggcccttctacctcaggaccgctggagtttgtatggctgtcagtgtcacatgcggttgcacagaagccactctcagaagtctgaagagaaaggaactgaataggagagttagtttcttagagagcccgtgggaggaccggagggcaggctcttggaagtgactctgagaatcatgccaaacagctcgtgtgctccggggagtggacagtctcaaagctgcagccccacctcccggcccgggacctcactccttctgcttcgattgaagcaggaagccactctgcactcactggctctgggagagagtgctcgggcaccagcttcttcagcagtgtccccgcctctcaacagtcatgggtggctactgctgccggacaccagacaccttcatacgcacgcttgtcagaacagcagaaacctggtctcaccttgtgtctccctccatcgcccataacagggtgtgcggtcagtgtgtgaaactccacaaggagtttgagaaatgcagtctcgtgctttctagcttctgccaggccggagagtctgtgcagaggggataaggtggggtagaacaagtctgtctgtgatatctaccacccagtctgcatttgaagtggaattatctcccgaaggcaaagaaatcacatgtcctattagaattctgcatgctgtgtgattctgatgccatgattcctataccttttggtcaggggtgtccaatcttttggcttccctgggccacgttggaaaaagaattgtcttgggccccacataaaatatactaacactaccgatggctgatgtgctaggaaaaaaatctcataatgttttaagtaagtttatgaatttgtgttgggctgtgttcaaagcagtccgcgggttgggcaagcttgctttaagtcatttgtgtggtgtgtcaagtagtgctacccaaaggtccctcaaaaagcatcattcgcccttgcctctcccagttccgagagaggagacagaattcagggctgagcctgtaggctgcgtgagtctcctgctcagtcctgagaagaagacctgggcatgggatgggatttagatgtagaatagaactgtttacgggggctcccctctgttccctgagcatgggttgtcattggttggcacaagtgccacggctgacaagctcctttctgagggagcagagcttgaccatatacaagatatgataatactgtttgtcaaggatacagcctgaaagaatgaaatagattgaccctagggaaggccactaaccggggaaagtaattccacttgtagctgcttttttttttggacggagtttcactcctgttacccaggctggagtgcagtggcatgatctcagctcaccgcaacctccacctcccaggttcaagcgattctcctgcctcagcctcccaagtagctgggattccaggcatgcgccaccacgcccggctaatttttgtgtttttagtagagatagggcttctccatgttggtcaggctggtctccaacccccgacctcaggtgatccactcgcctcagcctcccaaagtgctgggattacaggcgtgagccactctgcccagcctgtaactgcttttctactttacaggtataaataagtgttcctaagcaacccttcttaaaattagttattttaatgggactttttgtgttaggttattttagaaacattggtcacgtgtatatactttgggaattaaaaaagaaaagtggtgacaggttggaaaagtgtatcatccaacttctgatcaaacatggagcattaactctacacttatatcatctcttcctcctgaaaccccatgaagatgatagaaagacaagaagatcaagtgtgaggtacgagggaaaagggattggagaggaggcagcaggaggctgtagatgagatggcttgtgagacctttgcaggatagaaagcacttggagacacaggagctgaccagcggaacggggactgttgcagtcagagagcctgcagatcagtttacccgcgcaccctggacaggctcgaggacaggctgtgttggggggttgggggcgggtagggggcaagtggcaggagtggtgggaagtttacacacagcatggtcgccagctaactctgcaccatttcctgccaccacctctcccccttcccgaggaccaaatagttattcagcggagaagttgagaaagaccccgtagtccaaatgccaggtgtagcagagtgggaggtgaggacctgagaggagaagtctgcagactgaatggtggggccactatcctattttctgccgtccttcctcagacaccagcaactgatgtttatgtcacagtttagaagccagggggctgtctctgaagaaatggaatgggttcagagagaggactttcagatatttatatctgaaaacagaaattatactaggtatttcaacagagggatttaacacatggtaaagcccctctcccttttcccgccctccagtctcctgtggctgctcaatggcaggttctaacgaggagccagctggcaaaggggcctgcaaaaccagtctgcagagaatagtgtggaaaggtgggtttggagctgagaaatcagaagcgaatggcccacacagaggcaaataccagatcacatggttaaaaagtctaacagtcggccaggcgtggtggtcacacctgtaatcccagcactttgggaggctgaggtgggtggatcacttgaggtcgggagttcgagataaccctgaccaacatggtgaaaccccatctcactaaaaatacaaaattatctgggcatggtgacgcatgcctgtgatcccagctactcgggagactgaggcaggagaattgcttgaacccgggaggcagaggttacagtgagctgagatcatgctattgcctgggaaacaagagcgaaactgtcgccaaaaacacacacacaaaaccaagtctggtagtggttgcttttgggctgtggaacttggggctagggaggttgggacaggggaatattcattttgggggcagaagctaaagtgtgtagaaattaacttgacagtaatcaaagaggtagccaccctgcttggtttgaatcacagctccgtcactcacttgctgtgtgaccttgggcaagttacttaacctctctgtgcttcagtatcctcatcggtaaattgggtctaacagcagtgcctagttcctggggagtgacaaaaattatttaatactcttaaagctcttagaacagtgactggtatgtagtaaatattacataagtggtagtttaaaaacaacaaaaaaaaaaacacctgtaccattaagggctgagatggcagacaaaacctgagcttaggtgaagaggagtgtaacctagcaacattgtgctggactagatgaatccgcctcgtggaactacagccagtgagtaggagttgtggaaacagatttaatctttgggaactgttttgaattatttaggtatcggggctccgtattttacaagaagctgaggcagaagccatgtcatatggaccagctcatcatggtgtgagcataaggaaagactgacttcgtggcagatggtcattctaaggttccctcagggtcatcagtcatgagcccaaaatagcacgatgctgcagaggctgccatcctgagggatgcggctgccgatgtggttgctgcctggccttcatcccctcagtacccaggcagagaccgagtgggatggtaccacttgctcccttgggtggggaggacgattggagaaggatgagtgggctcacaacaggtgcccactcagcggaatccaatttcctgtctctgaaaggagaatcagtttgtgaaattgaccttaatcaagggtgatctgttcggagagtgctctatggatgccattcttttctgggtcttttggccagttatggaacaaagctcctcagtacctggcattgctttgacactggcatggagtcaggcatggtggctcatgcatgtaatctcagcgcttagggagggtgaagcgggagggtcacctgagcccaggagtttgaaaccagcctgggcaacacagggagagtttgtctttccaaaaaatgcaaaaaaaaattagccagatgtagtggttcatgcctgtagtcccagctactcaagaggctgaggcatgaggattgcttgaacccgggagttcaaggctgcagtgagttatgagtgcaccactgcactcccgcctgggcaacaggacgagacccccttcctaaataacaaaacaaaataacaaaaaaaacccttgcattaaccttaaactgggcctctcataactgcctggctccagaccattccagccccccacttccatgccctaaaatgtccagatcctgacctgcaattgcctgaggccatgggtcctgaaccccttcaccccttcaccacagactcaactgcatgtgcctttcctcctccctctttgctttcctcttctctttcttccatcatttctagtgaacattagataattaattttgttgttttcctaagatctacgttcttgagggcatgcaccgtgacttatataactttatattcactgttcccctgcccaggcagacccagcagaaaactaacctgtgtcattcatgttagttgatgaataagcgaataatgcaaatcaggcttttatgctctcactctctaacccactgccatcaggtgcctgaatattgccttctctccctttctccctcccatccatccatccatccatccatccatccacctgtccatccatccatctaactactaccccctcctcctgcagtctcccatccatccatccatccatccatccatccgtctgtccatccatccgtccaactactaccccctccccctccagtctcccatccacccatccatccaacccatttgcttctctgtacctctcactcttgagcttgttgacttaacatcaggaccattgatggttcctgcctacagtccccatcaccttcctctagcactggcgttttaacatagaaagcttaatgagtgcattcagttctgctttggaacaatgaaatgttaactttgtaataactcaagcctttcacataagggggaggaaaagattcatttcacaatgatactgagaattgtgtaggagctaatggaaaaaaggtcaaaggattttagatcctagaaatgggacaatgacaaaaattagtactattaagaagagtgatgtgctgttatgaaaaatatctacccaaatgtccctttaaaaagttatatttccatgtaagggttataattttaatattttggtctgtttccgtaaaagacattacatttctaaatttgaaggcaaatttccaatattaaaagatcctgtcaatgattcatttactcagctttaaatcttgtcttccattcctctttgaaaagacctgattattattaataatcagctctgcctaagttgtattctccttggatagaaaagctatgtatttgaagatcttatgctctacaagaaaatcctgcccagcgattgacgtgacaaacgctgaatatttcagtgcacaatgacggtggctttcagctcatgaaaggcttcctcgtgccttagatagtcttcaggtttctttcttagtgcaaacttttaagtggacccgtgatcctctgccctttacagcttttgtatccttcttgtgtcgattctatagctgttgtcagcaactaagcaatcttgttttttctttagatttgggaagctacaaactgtatctttctaaaccttccactcctctgccacttactgagctgttggaagcaaagtttaaagtataaatgcagtgtccacattcacagtactggattctttaatggcagtgagtgtggttattctggcatcacagaaagggagtggacttatgcaggggtgggggtggagagccatatttctgcacaatggcagtcaccttggaagatgtaggtggatctacctaagcctgatgaggacctcattggtgtccgggagcagggtgctccctgccctgttctggggaatgtgaaaatcctctactgctgaaggccttttgttctaagggcacctccaacccccacatcctagtagtcggctgccctcagacttaccacatgccaaatatgtttcatctttaagaagcatgctatctttatacaattgaatgcactctttgaatctattttacgttttatgattttaccttttttaaaaaaagtatcatgaggtatttcagatatgcaaagcaagtataaaggagaacggcgtgaatgtggacatacccagctgaccccttgaaggtgtaaaagatcagcagcatggccgaatgtcccttcccacatctcctgtccctcaagacacagacactgacctgaacttgctatttaacattccccttttagcttctttttaaatttttataacgattttaaaaataggaagaaaaaaaaggcatatatggcaagggcatagctttgggacatgctgtggtttgaatgtttattccctctgaatctgatgtggaaacctaatccccaatgtggcagtattgatatgtggggctcttaagaagtgactgggtcatgaaggctcatggattaatggaataatgggttcatggattaatggttatcatgggagtgagaccaatggctttgtaagaagaggaagagggacctaagttcgcaccctcaacccccttgccatgtcaggccctctactgcctggattctgcagagtcctcacagcaagaaggccctccccagatatagtccctcgaccttggacttctcagaccccgtaattgtaagatatacattcactttctgtatagatcacccaatttcagaaacagaaaatggatcaacacaggatgcatccatgctctacgtggacatcatcctctttcctccatttcattggccctgaagacatctgttctagatcctctgtctgttgcccttcatgaatttttggacactaaacttggcctttaagaaaatattaatgagctttttatttaaaaaaaaaaagatcactattcatgttgttgttactattacagtattaaggacgaactctgtgccaggcactctgctagaaactttgcagatgtagctccctttatttcttgcagcagtcctgcaaggcatcgttcttcctgttctcagatagggtgacagagcctcagtgagggcaagtagcttgtccatggttagtggcacaactgactctaaaatcttttaaccacatcaagttgccctagcatactagacgaaatgtgttaggactcagacatgtctgttttacatgatacttagatgggaccatgtgctgtggctgtgatttttttttcccccttagaggcatgttggatagggtgtcttgtaaattaatgccacttggcatggcaggccccacgagacttggctttcagtacaccctggcacctcctgcagtattgctggaaggagtctgattcaggccttatagatcatttatattacagagaaaggcatgtgagagtctggaagcaaatataaagtgcgctgaactccttcagaaatgggctctgaaaggaatcttagtgactttaaagagcaaagctaggaggattggctgcgctcatggaaattttccttttacccctcactgtatctggctgttaaatgcctgtcttccagctggcattctctttcttatttatcgtgaagagttagattatgttaaattgaaaagtgacactgatgtattagaacccatcacgttagattgaggacagatacctgacttaaaatgtgccctttctgaagcatcaactctgaaagtatttggtgttcttcccatattatacagttatacgataaagtcacaagaatgggtttatacccatttgtattctacttcgagtcaagtagtaaaaatctgtgaaattgactgattttgctcagaataatatcagagagggcaataaatctaaactttggctctcataaaatgtgtttctgggaaggtaatgattcatgatcagatgcacacacagacatcatgagagtgctaagaaatagattcataatctttggctttaaaaatcgtagactgttttttgagctcaaccagcctgctctggagttcgacaattctgtgtagtctttctctttctttggctctcttgatttgcttacaggcataagttcagcctcctgtgatgtgttgaagaggaagaaataatgattaaagtgatagaaaacagttctgcaaaatgaaagggagaattgaatttgtgtaggttaataaaggcaagactaatgtaatgcggtctttaagtataagtgaaagctatgctaaagcatttatcctccgtgtccacggatggtcagaggaaatggaaggggcttaaatagaaatggagaggtttctttggctgtgaaaaagaatttcttaatcaggaaggtaaagggcatagcagtggatctcagaatgatactctgaagctgtttcgctgttgcttccctttgctggacgcagagctcctcaagggcagggcgacccctgcacattccctgcccagagcagtgctggtcccattcatcagtaatgcccctctcccccccagcctacaatccattccaggaccccacctgctggctccactttcagtacatagccaggcgcaaccacttcttaccatctccctcgtgaccaccttggctcaagccaacatctctgggcactgggttcctttggctgcccccaggtttgataacaaaaatggctttcattgtttttgatttgtttcttttgattattaaggctgagtatttttcaaatatgcagtattgattattaattttaaatgaatgtgttgtttgctgtacacatttttgcccattggcttttcagttttcttgttttttaaagagactaaagttatcaatgttatatagtcaagtatattacataaattttacatttagaaagtaagttcaaatgtagcaattagatatatacttaactaagttttattttagatacacataaatgtgatcatatattttctttttttttccttttctttttctttctttctttctttcttttttttctttagagacagggtcttgctctgtgtcctgggctctggagtgcagtggtgcagtcatagctcactgcagccttgacctcctggcctcaagtgatcctactgcctcagtctcacaagtacctgggactacagatgtgtgccattgtacctggctaatttttaaattttcgtagagatggggtctctaacccctagctccaagcattcctcctgcctcggcctcccaaagtgctgggattataggtgtgagctgccacacccgtcccatatataccttttaaaaaggttcatcttttcctgttttcccttttcgcttctttcaccttttctttttttctctttccctccacatatataaataagctaatgtatattttcttatttttctgtatagtcatttagccctatacagccatgtacatgtacaagaggggtgtgtatacacacacacacacacacacacacacacacacacacagtttttattgccgatgttttaaaaaattagatcatattttatatgctttactctatgttttcatacttaatacctaaaaaaaatcatggaaccccatttacatagatctaatttattcttttaaatatgtataatctcccatgctatgtatgtcataattgatgaagtttttccacaatttcttttcctttggaaaagccccctggaattttattttgctgtatggcatgagttaaggatctaaatttttttaaatggctagtgaatggttccttgatgttttcagaactgtttctctcctgttgatttctagctcttcctttattatatattaatgatttatatccactatggtctgtctttcagctcacttttctgtacagatgtcaactttttgttgttgcttttgagatcattcaaatcacttttttatgttgaaataacttgagacttataaaagagttgcaagagagttctggttttcccttcacacagatttctgtaatgttaacatcttacatgaccctagtccattcatcaaaactaagaaattttcattggtacagtaccatttactagagcctttttcccagttttttttcctgattatcttttcctgttctgggatcctttctgcactcccatgttgcatttagtcaccatgtctctgtagacttctccaatctgtgaccttgtcttccatgaccttggcactcttttttttttttttttttttttttgagacagattctgtctcttttgcccaggctggagtgcagtggcgcgatctcagctcactgcaagctctacctcctgggttcacaccattctcctgcctcagcctcccgagtagctgggactacaggcgcccgccaccacgcccagctaattttttgtgtttttagtagagacagggtttcaccgtgttagccatgatggtcttgatctcctgaccttgtgatccacccaccttggcctcccaaagtgctgggattacaggtgtgaaccactgcacccagccaaacttgacactcttgatgagtgctgacccgttgctttttaaaacgtccctcgatttggacttgtctgatggtttctcacgatcaagctgactcatcatctcagggcacttggcgtcaacatgacttgtcactggcagcgacagggtggtcactcggctaaggcggtgtcagccagtattgttccctttccacattctgttcttagaagcaagtctcttagcccggcccacatgcaaggggagagtagttaagccccctcctactagaaggagaagtgtcagtgactttgtggacacacattaaaactaccacaaaaaattaattaaattttgcgtagatacttggaggttatgcacatactctgcttttctttgaagttgtgcccactaattttagcgttcaccagtggatcttgcctgcagtaactgtttctgtggatttctaatggtcatttttctcttcccctcattcttctacatttattaatttgaattctcctgcaaggaaggtttgtctcttcgccttcaattatttattattcaatcattatttgtaattgtatggatttaatgtcattggataaccagtagaataagtccctcatgtttcttctcctctttaaaaaatcttgggcctttttattacttttttgtttcttcttataaacttcaaaatacttatttttcgttttcaggacattcagttggtatgtactttgaaattgtgttaaatcttccaactgaatctggaaagaaatagtatctttaggatccagtaattcttctatctcaaattgtggcatgttctttccattttcccagttactcatttaggccccttctaagttattcacttaggcttctcggtgttgaaggcatacgaatatgttagaccctgtttatcctggccaggtgcagtggctcacgtctgtaatcccagcactttgggaggccgaggcaggtggatcacgaggtcaggagatcgagaccatcctggctaacatggtgaaaccccgtctctactaaaaaatacaaaaaattagccaggcgtggtggcgggcacctgtagtcccagctactcgggaggctgaggcaggagaatggcgtgaacctgggaggcggggtttgcagtgagccaaaatcgcgccactgcactccagcctgggcgacagagtgagactccatctcaaaaaaaaaaaaaaaaaaatgacctcgtttatcctaaaattgccatactgggctcgtgacttctctctacccttgcctgagtttacttgctcctccaaatgctaaatttggaactaggtgcttttgatttgtatgtctaaatttgactaaattactgtaaagtgaatacttagttcatggggttttttaaaatttattctatgcttttctttctttgtctcctgggtgaagttttgggtccttgtctccatgagatggaaaaatattcctttcccagaactttgttactgtttagattactatgcaggttctgtgataaccttcaagtataggtgattttataaaacagatgtttttggtgagattgtagcagggttgtgggtttggctctcagtctccaacgtttctgttgggcaggatttgcatttcatatcctggcatactgtattaggaagcttccagcctgtgtgtctaatattatgggggaacacaaaacttccatttcctaatttttaatcccttgttctctcaattcttagccagctggcactggagtaatggcatgtaaggatcttagttcccattattcattggtgagcatttctaccctgactgatgtgtgctcagctacactaatcgccatcttttacttacttacttacttacttatttatttatttatttatttatttattgagacagagtctcactctgtcacccaggctggagtgcaatggcacaatcttggctcactgcaacttctgcctcctgggtttaagagattctcctgcctcagccttccaagtagcttggattacaggtgcccaccaccacacccggctaattttttgtatttttactagagacgggttaaccaggatggtcttgatctcctgacctcatgatccgcccgcctcagcttcccaaagtgctgggattacaggtgtgagctgcctcgctcggctgccgtcttttatttttttaaagtcaagtactgttttctctgccatcacataccaaatgattcagagtttttcgtctggatcactcctaaatatacacacacccaatccctgaatcagaagaccaaagtccttcataccttttgagatagcttattgacctgtagaaactgtggtgcattggaagcccgggtataccagcagcctggcccagtttttgtcttggcctagtggacttgtccttgttacagttcttggttctagttgaacaccctttaactttcttttttacacgtttttacaccctttgtccttcccaccctaacagaaatgtcctgaactcagacatttgcacaacaaattgaaatttttggcaaattcctttcattttcctagtatattccaaagcacagttaaactagccagactaacctgatggtttttgagcaagggaagacatagatgcggatgattaaataagacacatcactatttcatttatgagacattattgtgtaattagctatttcatataactgggtttttaaaatagctgaatgtaatatttcatcaatataacctttcccccattctttgtggttgggttaatgaaaacttttctaatatgtcttcacttctctttggagcatagtgcatataatttattctctttccaatgtcattgcaaggttataattaaaagcatgaattccctgtttcatgaccctagagtctactgaatgtttaatccttttttaaaaaattcactaactgacctcagctgtgcattctgagttcttacggctacatttatataatttacttatgaccattgtagattgtcattgtgctctctctctatcgtcctctctccttagccctaagggttgagcaaccagatcatcaggtttgacgaaaacaggaaggagggcctgggagggatggattgatgatgagtccttctcattgataaggaccctgagcaaggcctggtgagttctagatgctgtggctgctcccagcttgcatctctgtctctctggttccttctcctcttgcttccttggcctcctttggcccttggaacacgcccagcctgtcccattgcagggcctttgcacttggagctctcttctgggttttctcacctccgtcttcatgtggttctccctgttttgtgattcgattctcaaactccaacatttgtgtctccctgaaaactccagtgagaactctctgctgaccagctggaggatgaaacagcttgttagttttagtttagactttctgctttcatggattgagtaggggtattcctttttcttttcttcagcagagctgttctcttttactttttaactttttactgtgaaactgtacttaattatacattcacagaaggttgcaaaaactattcagagaagttccatgtacccttcacccaatgtttatattttataccactgtagtgcaatatcaaaaccaggagattgacactagtacaatgtgtgtttgtagttctttgtcattttactacatgtgcagatgtgtgtaactaccactacatccacaatacagtgctgggctggtctcacgcctgtaatcccagcactttgggaggccgaggcaggaggatcacttgagcctggaagttcaagaccggcctgggcaacataccaagaccttatttctaaaaaaataaaaataaataaataaaaattagccaggcatggtggcacgcacctgtagtcccagctactcagcaggctgaggtgggaggatcacttgaaccagggaggtcaaggctgcagtgagccatgatcatgccgttgcactccaacctggggagcagaatgagaccctatatcaaaaaaaaaaaaagtgctacagagctgttctgtcaccacagacatccatcccccttgtgctgccctgtaattgtcataccttccctggcagcttcccaacctggcagccgctaatctgttttccatctgtacagttttctcatcttgagaatgttatgtaagtggaccctacattaggtgaccttttgggattggcttttccccccacttaacctaatactcttgagacccatccaagttgcatgtatcaatggcttgtttctttttattgtgatgccggattctgtgcaacagaggtagcagtttaactcttcaccaattgaggaacatttgttgttgtttttgtttttgtttcatcccaaggttttggttgttacaaataaagctgctatgaacatttctattcaggtttttgcgtagatgtaaattttcatttctctgagatgaacgttcaggattataatcggtgggtcgaatgtaagtatatgtttggctttttagaaactaccaaagtattttccactgtggctatactatttttcattctctcagcaacatatgagagctccagtttctctgcattactgtttttttacattagccattttaataggtgtggaagggtaggtcatcatggttttaatttgcatttccctaatggctagtgatgctcaacactttttatgtgcttatttgccgtttacatattctctttggtcaaatgcttcttgttgtactctgcccattttcttttcttttcttttctttctttctttctttcttttttttttttggaaacaaagtcttactctatcacctaggctggagtgcagtggtgtgatcttggctcactgcaacctccacctctgaaattcaagcaattctcccacctcagcctcctgagtagctggaactacaagggcatgccactgtgcctgattaatttttgtatttttagtagagaaggggtttcaccatgtggaccaggctggtctcaaactcctgacctcaagtgactcacccacctcagcctcctaaagtgctgagattacaggcttgagccactgcgcctgttacactttccccattttctaattggatttttttaattgttgacttttaagagttctttatatattctagatatgtatgctttatcaaatttgtgttttgcagatattttcttccagtttgcaactggtattttcctctttttttttttttttttttttgagacagagtctggcctgttgcccaggctggagtgcagtggtggctggaatgcagtggcatgatctcagctcactgcaagctccgcctcccatgttcacgccattctcctgcctcagcctcctgagtagctgggactacaggcacccgccaccacgcctggttaattttttgtatttttagtagagacggggtttcaccatgttagccaggatggtctcgatctcctgacctcgtgatccacctgccttggcctcccaaagtgctgggattacaggcatgagccaccctgcccagcaatattttcctcttaatagagtctttcacagaacaaaacattttaatgttgatgaagtccaattgactgaattttttaactcatgaattatgcttttgctgtcatatctaagaactctgcaatttctctgatatcttctcctaaaaattttacagttttacaaatatatttatgatgttttatgggtttatttttgtattcagttatatgagggtttggctgaggtcagttttcttttttcttaagaatctccagttgctttggtaccattgttaaaaagacttcccttccttcacagattggtttttgccctttgtaaaaaatcttttggccctactgttacgggtctctttctgagttctttattttgccccattggcctatttgtcttttcctttgccaataccacactggatatagctgtatatctggtagacttattcctcccactttttgcttctttttcaaaattgtttttgctattctaattcttctgcctttacatattatttttagaatattttctctataggaaaatcttgctgagattttgaaggaatcacattaaacacgtaggcctgttcggacaaaaccagtatctttactttgttgtgttttccaatccatgaactctttatcactctccatttgtgtagaactttgatttctttctttagtatttttgtagttttcagcatacaagttctgtacgtatttgctaggttctcacctatttctgttgagtgattgtcagtggcgttatattttaattttggctttcacgtgttcattgctattatagagaaatacaattgggggtggaaggattggtgagatattggtcgaaggacacaaaattttagttagaaggaataagttcaggagatctattaaacggcatggtgactatagttaacaacagagtgcatacttgaaagttactaagagagtagattttaaatgttcttaccacaaaaagaaaaaaaatacatgaggtaatgtatggttaattagtttgatttcaccatttcacaaggtactcatatatcatgttggacaccataagtacatacaatttttattcgtccattaaaaagaaatttgtgctatattttatgctactaaaaaatacagttgttttttgtatgtgtatcttgtattctgaaacccttgctgaacttatttattacttcagtgagtgttgttgttactgttgctttgtagattccttggtatttcctgtgtagaccacgtcatctgcaaatagaggcagttcactttttcctttctgacttgaatgcctttgtattgatgctcaaattgcccctttcttgggtagcgggagcctcttcaggttgattcttgagttcttgtgacatgacgtagtctttgctttcttgctatatggtataagatgttctgggttcctcttgtactttttctgccctgacctataattaaccatttctctaaaatgtactggttcttttttgtggcaaatggtattttgagaccatagcagttcccccagtggagactgtagactgtagacttatagagccttgatagtctcttatatattagtaaattccccagtaagtgctcaataattgtttgtcagaagagtaagtgaattagtgaacaaatgtatgaaacacatctagtgctagtctttgcttggtggccaaaccaaaacaagaaaaacatcatccagtgtatccaaaaaagaaatattgtcaaggcaattcagatcattagtgatctgtcaaagaatgaccaaattaatggagaaccaaaacacttctctttaaaccctttttctccttccaagtcacctccttgtagctggcctggctcctttgccccctcttcttcctttacagagctattctagttttcgtgcttctctcctcagtgtgaattttcaaggtgttcctcctcctatagatctctgttgctaccacaaactgcatgataatgccctgaggtcaaagacaaggaaagactgcaaatgcttggcttgtagccctcccaccatcttcaaagtcagcagcgtaaactttctcctctgccagtgactcttctgacttctctctcactgctgggactttgtctcacatggactcacccaaataatccaagacaatcttcccatctttagatccttaacctcaccatatctgcaaagtccctttcccatgtgaggtaacgtatctctaggatgtggatgtccacattaggatgtggatgtccacattaggatgtggatgtccacattaggatgtggatgtccacattaggatgtggatgtccacattaggacgtggatgtccttgggggcccttattcggcccaccacgagaaggctcatgtgacccaacagacggctaaagagttgggccccagagctctgtgatgctcacccttccctgccttctccacccagcagagaccgttacctttatagaccctagcgaagaattttctgtggcctttggtcctttgcagaacttcacacctgttcatttgaatcattttgcaccagttacatactgcttgtggcaaacctaaaacgcctgtggagaaatgtgacgaggactaagaacaaatacatcacaacctatgaaaccacgttgcagttctctgaggagatgaatggagcaattacgttttatgttattgtgttgtgtttgtcatggaaatgaactgcacaatcattaactggcaggtggtggagacgggaaaagtagctgctgcccctttttctatttttatccagttttttcccgtttttatttttgtgtggggttgtctgggaactaagagtgatattacctaaatttgcttcctgcctgtatcttacgtgtgtattgttgtggttaataatgttttcaatttactcagactttctcaaaacggccctttttgagttatcgatagctgtatttcacccaggcaaatctgaagttgtcatcttattttctcattttagatatatcctaatgttaaataaaaaggaatttataaagccttacctgggaaagtccaaagttcttaccttttgagaaaaaaaaatctaccccatccccaaaggaaactgctttcattagtcttcatggacggaacccagggctcatagctctgcctcttattagcgggactgacagctgcctagtggagaaggtaacctccagaacagtcccaaagaaggccaagaaggcctgcctaggagggttctatcaggataggaaggggaagtgcttaacgctgacacacataactcgggtggtgtgggggctccctcttgagacccagcatgctgtggtatagtcgcgctcccggtagatggtaatgccaggggctgcctcaagcccaaagattcagaaaatctacccctgcatttcgtcaccagttttgtgatcccctctaccataggccaggcctttcttagccagtgggggtatctgattggagacctatagaaagggggagacagagacagacaaagacacacgaagacaggcacacagagagaaacagagagagtgggccaaggtgcagaactgttaacctcacaacaaaggtttgcacagattcctctccctggcatgttgtctcactgggtctggggccagggagatgacagagacaaccattaaaggacttgatgagagaatacatttgggatgggcacaggctgggaggctgggttagagtcttgattgttcatgttctttggcaaaattatttgacctctggtagcctctgcttcctttctgtaacatggagataataacagcagctaagcatttctgagttttaagtgtatgccaactgtatgtaccaatcaccttttaatatctcgtttaattctcctgccaacactaagggatggatacaattattatccccatctgacctgcgcattggtgctgtcagtcaagcatctggcccgttgtcaaagcgtcaccagctaggaagtgtcagagaagggactcccatgcagtcatctctggatccaaaccttgatgttaacccctggttgctgcaagggaatttgaatccctgtgggatgaccgtgagggctaggtgagatgcatgcagagcacacagcagttgccaggcccgtggaacgtgccctcctcatcatgacggcgaggagggcagagcagaagctttgtagagaagaagagttgacggggagcatggtgccccttctgagaagtgacaaacaactccaggtggtggttgagtgaggagcagatggagggtcggtccctagggaggtatgtccaaagccagcaggttcactccctctgaaatcctacacagaaaaatctcagaatgctgaaaggatgccagtgtctgtctcccaactgtggctaatggttcagtgggatttgcttactggcaacttctgaataattcccagcacaggtgtaaataatgcaaggcctcaatcccagcccgacctgcaccgtgaggcagaagagacatgtgtgtcacagttaaccaagggtgcagtaagccctcctgaaagctcagtttaggggaccaggattttaaagagctcccagccttgttgataaatcagtttccacctgatggctgtttgatacatcagtttctacctgatggctgtttgaccatttccctgtacttgttttccagaacagtgtccatcgtcacagagagtgatggcactggcgggctgtctgataaagcaaagaacccaacagatgttgtttacacacaaatgccatacctatcgtagtagcgttcagaaagaaaaaaaaatcattaaaaattggattttcatattgatttattttcatcttcattgttgatggtgtttgtgcgtgagcatgatctatccctgtagttaggggagcctgtgttttgagtcgtgcactgaggatccagcatcaccaagggttattaggctgttcttgcattgttataagagaatacccaagacggggtaatttataaagaaaaagggttgaattggctcgtagatctgcaggctgtacaggaagcatggtggcatctgcacctggggaggcctcaggaagcttctaatcatggcagaaggcaaagggggaggaggcgcgctacatggcgagagcaggagcaagagggaacgagagaagggggaggtgccacacacttttaaacagccagatctcacaagaagtcactatcgtgaggacagcaccaagaggatggtgctaaatattcatgagaaatccaccctcaagactctgatccagtcacctcccaccaggccccacctcccatactaggaattacagttcaacatgagatttggatggaacacagatccagaccgtatccctgagatcagctgtgctcgaggtgctgtgagtctgccttagccatcgcaggtgctcccgtctctgctgggcacagctttgtcactcggcaatcgaaaagagtcttaacacgagagtggaaccctttggtcaaaattatgctccttcaaagaggaacaaatgtggtgacagactggaaaggtgatggaaagcatttcaaaaagcagttcactctgctcataattttctagtattcctctgctattatttgcttttaaagaagagccctctgcttcctagcggctgctgcgtatgcttggtccagccacgaagacataatcctctgcgggcagcatcacgtggagcgagggtcaagtcctctgcctggtgcgcctttatctgcacaagggaagaaggaatcctgagtgcctcgttccgcagaaagtgagacacagaaagcatttgacttgtcaggaatcgagaattaccagccccaggcttccccaactcagctcacgaagtaagaatggctgggccaacgcttctctgcagaggctgcaggtgcggacaccgacagccatgcacagtcctcccaggaatattcttgtatctgctgtgtcttgcttagccatggccatatttatttaatttttgatggaattatttattgtgttttattctcttgctatataaactgagctgatttcagaattgactgctgtttgcagagtatcctggggagaggaggattcttcatgaggagcccccccatatctggagcagttttagttggtcctcatctactttttagacgcctttctgtcctcacttttcatggtttccaatttgactggattttacactcttgggaagttccactgtttaaggatctaaagactgaaaacatgtattccgcacattttgtttaaatcatgtttcttttttttttcctggaatttttattttagcagaaaaagtcttggctggaaatgtttctgcctaaacctgggctctgtaaaaactcctccttcatgccgttcctctgcatatgaccacaccaggaatttggcatagccatttatttgtacctagtgctgaaacaattagttaaaataacaaaaggcccctggataagtacaaattgactgaagtgcttttgaagattagcaaggaaatttaagaaacattgctataaataaaaaatatatttattctgggcaaaaatccctgatgaaataaatccttcactagttacatcaacagttaccctataatctcttcatttcttttctgtccctcctactagacagcatctttcctaaaggaaaagaatcaattctatttatgacacataaacacatgtggagaaaaggccagggattttccagcactaaagtcttgtaaagtggattttaacgttcgtggcatctgggtggaagtatccgaagacaagttgtttctaggcctctttgctaaattattacatgtacgctcttgagcagatgggctttgttttaggtaatagaggcttctggtcattttatgactctaatgtgataattcagtgaccgagctgtgtttttacagaagcctattaactaaaactctaggaagtatttgatatttagcccctagaagaggacagtagatgacatttactgttttcttacttgccagtcacattctacacctgatgaaccagattcagacttagcgtacatggaatttgtagcttctgagccagcctcattcacctcactaccgatttgcacttcatcagtgtccttttgatgtcagaattgttatccccattttacagatgagaaagccaagtgatgagcctgtgggagtaaaatcggggccagatccagttccacttctcttgccccacccaggtcacagttgcctgatcgcgttaagggcctctctatattaagacagaatatcatggtgtcattgatggtgttacttcctgtcaactgtgatcatcttgttctggtagaaaagtgaggtgtcttctctgcagaccacattagattttaactttaagtcaggttcgacactacttctggttccaggaaactcagggagcttggttgggagaagatgcaagagctctgagctcacatcttctttgggctttaattcagagaccgacaatatgcacccaggcagatgtccctctgtgcctcttttctgaccacccaccaaagcccctctctgctgctgctgttggccatggtgctgggagtagtcagggagccccaggccagccccgcagttcaggagggagttggatgtgctgcctggccgtgcagaagcccccggccagagctccggtggaaggcacgtgggtagatggtcagcagggatggcatttcctcccacgccacctgcagaagcagccattctgttcctgagttattaataccttgtaggctagagaactgggtctgtcttgctaatgtgatatcccatcagatttttacactttcaaaagctatcactagggaaacagatgtggttggacctgcgtgctttgtggtgactttgctgcctgtgtggcgtatctacttttcctctaaaactctgtaaaatgaacagactggcttcacacacttcatactgccatcatttatctttttatgcctttgcagctcttgccagtaagatatccccttgtgttcaacaaccatattttccagtatgtcttccctggacagtgttaacacacacagtaggcactgcaaagatatttagaaaatggttaaattactcctgtatttgcttgggttccaggtgcctgaatgtgcaagctcagaaaggaatagtcagagtaaaaatgcaaatacaaatacttagagattcccttctttttcttcattaatttaacacacatttatcgactacacactgtttggctctgtgattaaatactggaggatccttgtgtgcagggaaaacaaaggtgtatctgaacgtatttcaaatccaaaggattttaaaggagttaccattttagaaattccaccctgcaacttaccaccgcttgggtctatatttaagagttgagagacagtcaatatagaagagttggatagaaggtgaattcacataaattcaatggaatttttccatatacttgccattatgagattaacaatgactctcctagaaaaggatgcccgcgtagactaacttgaaatgtttttcaaggcatgggccattatggtaactaaactggtggaggcttgactggtcttttcctgcctctagtttcttccctctctggtcatcttttggtctttctcctactgcagaagtataacttaccctttcctgaagaatcacagttctgaagtttaatggctttctcctctgagcaagcctgcctgcctgaatgcagttgtgctgagctgcaatcccatttgcccaggacttcttggtctgtgctagggattcatgcattccattaatgaacacaactcagctagtggtttctgttggtttgaaatcacgagaaacaggtttcccaaattctttcttcttttgcttttaagatgtttttcttacacccagagcaaatggtcagcagcaagtgtttgctcttgatggaataaacatatcactctggcgacttaacatgtactgagcattcagggactcattagtgccaaaactacttgaaagcaattttatttttatttatttatttatttatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgttctcattgttcatttcccacctatgagtgagaataggcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcagtaaacatacatgtgcatgtgtctttacagcagcatgctttatagtcatttgggtatatacccagtaatgggatggctgggtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttgctgttttggacataaagtccttgcccatgcctatgtcctgaatggtaatgcctaggttatcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccgttgatctgtatctctgttttggtaccggtaccatgctgttttggttactgtagccttgtagtatagtttgaagtcaggtagtgtgatgcctccagctttgttcttttggcttaggattgacttggtgatgcgggctcttttttggttccacatgaactttaaagtagttttttccaattctgtgaagaaagtcattggtagcttgattgggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtatgttgttggtgtgtaagaatgcttgtgatttttgtacatcgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttctatgctggattacatttattgatttgcgtatattgaaccagccttgcatcccagggatgaagcccacttgatcatggtggataggctttttgatgtgctgctggattcagtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccaaggatacccaggaattgaactcagctgtgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattataacaaactatctctcagaccacagtgcaatcaaactagaactcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagagggcaagaactaactaaaatcagagcagaactgaaggaaagagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctataagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaattgaaagcaattttagttcttgtcgttgtacagctaaggaaagttcatcagtttctaagttgtctgccttgaacttgcttaaattgtgaggcatgagatccagattatactcagaacactaagccttggaatcaacccttttaaaagttgcttaattaaaatggagaatattttgaagtggtttttttttttaagattttacaaactaatattctgcatcttcctgcacgctgaccttctgttaatgtacttgaaggtcaattgaaactagtcaaatgttactttaaagttcgtagtggtaaaactatagactcaaattatgcttctatgtttaatgggcaaagttattattttactaaacattttactgaattttcatcataatgtataaattgatgtggatattaccaccctagtttgtggtaagtgttaaagagcaaaatacttattgataaccaaagacaatttatattttcatggaagccaacggatgggttacagtgcaagttttgggagctcatcatgaaaatgttcacatcatgaaaatatttctggacacctcctggaactcttccccttgggtccatagatactcttaagggaaagttgttaaagtgccccctgttacttcttacagcttgtaagtacacccaatcgaagctctatgggacatgaacagtgtgtcctggttcaggttagtgtctcctccactctgagcagggagtgggatttccaatagttgctgattaaatagtgaaacagttacttgattctgctccagtggtgatcagggtgaatgtatactcttactcttccttcctggtcttcaggcacctatgcagtgcccagtgggctgttttcaccaaccataaatcctgtgcttccaggattccgacgtcagtatcacatccctgaaggcagctgatctggtgtggtctggggaaggccacaacccctggccatgcaaacatagcagggagcttcccagtcgatgcctagcaaggtggccctccctcccccatgcccaaggggtgggtctagccatcatctcaatgcaggtggtcagagacccagctagctactctcttcctcggatttcatcttttctgaaatagagaactatgattttgcctagcacctcaggagagtgttggagaatcaagtgaagaatggccagaagcacttagcgagtgctcactggaaatggtcttcctttactgaactgcacagatactttgctcatcagtctcagcaatgaaaagcaacagattgatttctctcttgtgaaaacccttcctgtgcttataattcgtacctcaggaccggttagcttgttctttatgatgtagcagtgtcttctcccgagcggcagctcatctcatccatattgtactcagttatttttgttcctcttctctttactactatcccatggaattgggagttaaaatgatgaggtttcatttttaaatgtacaaagatgggggaagactaaggaagtaattttatttaaagccacacatacatttgtttcaataaagttaaaggaaaatctctcaggccaaatattgtaatttttctatgaagtcagtgtaagttttaaatgtgtcatctggagctatgttataataaggccaggtaattcatattatgggcaaagtattcaactttgctaccataattactcagcatgcccctgtgttcttttcattaccttctgatagcaaaagtgatatttattgtggaaaaactggaaaatattttaaaaggtagaatcaaaaggaaatggcctgtaattgtaccactcagactaaccactgttaaccttttatgtgtacacacatatgtagaaacagatacataggacttatttgcagtgcatagaacccttaaatccaaaaaagatgtcatcgcatgtgctgttgtgaatctgtattggagtgttttgatttctagtgacagcagccctaacttatcacggttcaacaggaagtatctgagctcatgaaccaggaagtccccagacaggacaggctgctggatggttggttcattggctctatgagataatgaaggacccaagtgctttccgttctctctattctgctgccacaattatcagcttcatgtgaaggtcatttctatcatggccataaaatcaccaccatgaacacgttggacaaaatgatcaagacccacacctgatgctgggaatggggccagctctcttgtgttgcatggctggattgcagggggaaggcatggttgccacgacaaaatcagggccgctaagaaagaagacaggatgggcacacgatacttgctttagtgtctttaaatatggttttcttcttaaggtttacagcagttaccagaatttaaaattaagatgaatggttttggatgttttattttcatttaaaaagtcagtctcttgtagaaatgctctgttcagaaagatttggataggaacaaagacttggtttctgggaaattaatcttcatgatctccaaagatgtagcattttcatggtgtctttttggcagcagcagttttttttttttcatgaattttggcttaaacctttatagaaattaaaaactaaaagaaaaagataagcttaaagataaaagttataatagatggaaactttaatatttttatctttatgtacctttttattttcaatactcttgaaataatgccgtaaataatatcgagaattcatggatattttataaggatacttctgagaaacaataggcatatttgaaattactatggtaaaaatcagatgtcaaagaaaaagttatatattcagtttttaaattgtactattaaatgtgtaacttcatgtgtagtaaatattcatatttaattttagctgccagtgtaacatatactaaaataaaatggaacaatttctatggttctataaaagaatctataaaggagtcataaataattataataaaactctattgaaatatttttatgagactaaaaattgaaaacttcctaatagggaaattttcataaatgagacatgaagtaagtcatagagacctcaaacagtaatatatcctatgggaaccctgaataagcaataacttcttaagataattttatataatgtgtaaaaatcaagagtttttgaaaaagctctgcaaaaggtagcaggaagaaaaaggattattataatgctaaaattcctcatgagagattactcattttgcatgcttttgatgttaccagaatacagattttagataatctgaatctgaaagtgctgtaactattccctatagagtaccacaattgtggtgggtaacacaactcactctagagacctaagatgtttctcttgtttttgaaataagagcttagactaaatgatattttggtgctcagaatgcatcttaccttctatgccaaattcaccagccaatgaatagtttactcacattcatattttttttctttcttttttgagacagagtcttgctctgtcaccaggctggggtgtggcggcgtgatctcagctcacttcagcctccgcctcccaggttcaagcgattgttctgcctcggcctctgtagtagctgggactacaggcgtgtgccaccacgccgaactaatttttgtattttcagtagagatgaggtttcaccatgttggccaggatggtctcgatctcttgacgtcacaatctgtccacctcgccctcccaaagtgctgggatcacagatgtgagccactgcgctcagcccatacttttttaaacaaattttaccaccctcatccacctctttaactggcaaaaagaatacggaattataagtgaaggatcccataaaacacccatttcaaataaaagttccttggatgaatggaagttgtgtctttcttgtttttattcttttttaaaaattaagtagtataatgagagtctttctatggtatgattggatgagtattaatctgcctgtgaaaacaccttctcccttctctgctgttaagttgctgtgttacctaagacaagcaacttaacttctgtgagcctcagtggcgcagagaaagggcaggtgcattaaacgagtctcagagatgcctttcccagtagaatcaggatgaatgagaaggtcttggtcacgatcaagaagactgtttactcatcctttgcacttctaagacatggtgagatagtacaggtgaaaaagacgtggcctggagttaataatgatggtagaagttaagttgaaggggggcagcactgtgcccattggcgactttccttctacgcaccagtgtagatatccatacacaaagcctctgatgaggctccctcgaggtggagaaaaccacaactaattcacttgcgctgggtcagggttgtggtggtccagccttctaattgaagggattccttctaactggtcttgttatgcattctcagaggaggaacctctgagttttaatgaactctggatgtctatgttccagaacattgtcttcttcacagtcaggtgctggcgcagatgtggagcacccggtaggctcagacactggggctgcagtgtgccagctggatcagaagaggctctctctggcgttgtcgtattcttaaagtcggcctgtgtattgtttttgtccttccagctcttcttttaaactctaggcattcctttatagttggcctaattaattttgtcttacaagtaggaagttccctggagtagctttgacactgtcctcttcttttctgaaacagagccatcacattggagaatcagctggtgatcctcgccaccacaaccagtgatgccggggcatactacgtgcaggccgtgaatgagaaaaatggagaaaacaagacaagcccattcattcatttgagcatagcaagtgagttttgaaatcccaaatggtaattctgcaagcaataaaatcttgctttaatcagtaaccactgtctgacaggacattttgcaataaattttctctctctagtgtagtagttacggtttaatattgatccagtgccaatagttcggagagctttagggctcttgctttcttcaaaatgatatgcggaaaaatgtgaatctcagtggtacttctgaatgccagatcttttttgggaattaaaaaaaaaagtatttgctttttatacacagtcaatgcatgttgttcctaacaacaaagaactttcaatttaaatgaattgtatccatgaacctaaatcaggactagattagatatacattatattcttttaatctaacaggaaaatctttgagaaattctacctattaagttgtacgaaaattagcagtatttaagcataatcagttgatcattttttccacctaatttaactgaaagcctgattcttgaagacaatgcacacaaatcatgggtatttgtcgattttatttgaggggactttagtttgagtaaacttagttttacatgtttggactttaaattctactagcaagagttaattgctaaagaagggaaaatcacccaaagcaggaactctgaactaatctagattcagacatccatatcagaaggcttgtcatcagatgtttgcagcatgaagcttcatggtatgaaatgaaattgtcatgcggttgagaaaatagggttgaaactagtcatggcggatggtaaatttcaaaatattattatcatatcatatgagtgaattatattgatttgtttgtatagtagtggattttatctttttaaaaattgtcttgaaggaatcgtttcccctgcaagtgatttgaaaagtatgtggggctaggcatggtagctcacacctgtgatcccagcaatttgggaggccaaggcaggcatattacttgaggtcaagagttcgagaccagcctggtcaacatggtgaaaccctgtctctacaaaaaatgcaaaattagcaggcatggtggtatgcacctgtaattccagctacaggggaggctgaggcaggagagtcacttgaaactaggaggtggaggttgcagtgagctgagatcatgccattacactccagcctgggcagaaagaatgaaattccatctcaaaaagaaaaaaaaaaaaaagaaaagtatgtgggatggagtgatagtatttgcctgacatggccctcgaggggtacaattgccttaggcccagtagaattgcctgggtgaatctttgtagcaaactctgggtgcaggcgtctgtgggagttaactgagtggggtctcagatgcctgcctaattggtcccaagtggccgtgatgtgctgtcatcctgccttgagctccttaatttgaggaattgaatctcgctctgcagaacgtagacttggcacagatttaggatgagtggggtctttgtgatgccatggagaatgatgcacgtggattaggggtggggttcacaaaacccagtgcatgctgtactgtgacgtaaaggagtgtctgcattgagaattacagtagaaatgaggatgatttattaagattttttccaagggttatgataaagaatggaaattgtattatcaaatagattgttattattttaatgattccaaactttacaggtagagccatttatcttgtttagcaaatatgaatctgtactcaattgtaatataactaccaggataataatgagtcaaagggggtgaaattctgcatcagaaacaaggaagttggccttcctctgttagaagaattattccactgaaactgtttaacatcacaaagttataaaacagtccgtacctagtacttgcctacctccctactctgtaagggccagcagaaaataaagcgagtacagtgaatttgcaaaccgctgtactagcgtaataccatggtgttagataattggaatatgtaaatttttttcagtaatttcagtttctaccctgaccgaaaagtatattgaaagctactcataaatattataattaactgggttgcattttgttcctttgtatgtattttttaacttttcattggcaccaggtaaaaatgtgtaaaaagtgagatacaaggcagttgatgatatggacttattttaaatcttaggacaaaacctacattttgttcctttatgaattctttgctttttatgagtgccagataaaatgggagaagtaaggagattgaggaaactgccttattttaattcttaggagaaccttcctggtgacatacgggatttacgtaaatgttaaatggcaaccaattatgcttttttgtttttttgtgttttttttttttgtttttttttctgctaaaagttttattttgaaaacctctaaaagtcagaagtcttgattaatctgcagaatcccccagaattgttttaattgtgcttctttctggcatccagtgagggctctaagcaatgaacactgcagttcaggacctggccaccctgctcctggtgagggtgtgatgtattgaaggatgcgtctcttcaccagatttattatgaaattagatattctcaagacctattgatactgggagtaagatagagtgtgttctgcagacttagatatctttttcttctgatgtaggcttttgtggaaacaccacacaagattgaggaaaatttgtaaaaactttctggccagcgtttctgaaaaatcaaaagatattacagccaattatcatttaatgaagatacatttttgcttgctgtcgggagaataaagcagggaacctttatgtagtgaacaccatcgggatgatcgggtactggtaattaaattcctggtggattgtgctgtaattagtttaaaatcggagtgtcatgcagccccgcctcttgtttgctgttgtggtaataatccgttccttccttgaggacagcaccgtgttagagtggagcggcaaccaggtctagccctgtctcaaaacatctaaataagtgatgcgctgtcacccagctaacaggaggaaataatacattttcatcaacaaccttgtacttgagagttcaaaaacgtcaccccttttcaattgctagatactgtggctacacctgaagcttatgggaagcaaaagatagataggttttagatttaaatttttttttaaagaaagcatgactgttagaactgagatgcagtcccataatggtaccgcctgctgtttagtgcatatttagtagatggcattattatctctcaacatttctcccctcttgcgtggttaagaagataaattccagcatgttctgaaccgatattcctgtagggaaggagaggatttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctctaaaaaaaaaaaaaaaaaaaaaagccacaggcgatgagacgaattctatacagtggttaatcagtcattgtttatacgccattgtacatgccttagacataccatcagttctgatccaatattcaaaatgtccaatgtaatgagattctctactagggatgaagcttggattaaaaagaaatgactgcctctctccttcctgtttttttcacctctttcattttaatgtctcctcttcaaacaacatttgcagataggatatcatttcagctgatcctccttcaggctgacaaacccttgcttttaattctgaagaccacttaacattcttttgtcctctataatgctaatttaactgcagactcacgtagggttagtagttgaaagtggattcctgagaatgtccatgaacagtcatttcagaggactgccctgtaaaacatggcttttgtgtgcccaggtacaactctctcctattttccttgtaccgttaacattaaagggagagaggggaacaggcagatgccttccagatggcctctgacttggctcgggttcctaaaacaataggaactgtttgaaatattactaaaaaccaatctggggcctagccccacatcacaaatgagcaatttagaaccaagcatagttttatagattgtatgacactttactgccagaatttttcagaaacataaataggaagtctattttatagtcaagtcatgagtttaatcatttagccatgcatcgaacctgctgtacggagtgaagtgtgaggcatgctctgccctggcctcctgagctggtgttggacagaactaagtctaggccatggtccctaatgcttttccgtaaacacaccatcaggaaacaagccttgagcatttactccttatgcatgaacacctagttacttatcaattctaagcattaaccatcagacagaagagaggacgggaatcagcagtgctaatcatgaaggttccgttccgtctttacttgacgtctcatggcgcaatatgcactttgtgaatggaaatccatattttacttgattttcttgatacaatctagttttttggaaaaattcttatgacatctggttacagataattgtttcttcttggcgacgtggcttctactaacgacacaagtgttcctgctgccgtttgttgccatctgattgtgctggtgttgtgagtgactcagatctgtgctttcttcccagaaatgccgtcgtcttcagttgtccactttgtgagagttagtttagataaaacgaaatacacaaatacataaatccacctctccgggcaaaggtgaaactgcatcccatgcctatgagggcatcctgtccacttctctgacaatgagaattttcagacccttccttgggatagcttgcgtacagagtgtcacctggggccacctgaccaacagactcaacctgcataataaataacattgaaacttagtttccttcttgggctttcggtgagaaaacataagttaaaatactaggtctaatatttcgtttctgcgccccaaatggatggattggggaatgagttttagaagaggagtgtagctggtggctcccagcaagacttcactcaccacaacaaagaccatcattctctcctcaccccacaaggcaaaaccggatggtttctattgcccactcatgcctccttcaccatatccccatctctttccatcccaaggtgtccccttttcccctgtgtgatttatttcaacctgatttcactgttgttaaatcttaggaaatctaatctgtcttaaatcttaggttaagctatgatcatttgccctcaaagtttgaacacatatgggggaagctcaatatgcccggtttcccaaagcagcagtcactggtctgagtatcactcaggatacatatagatttccaaggcgtaggcaggcatgtaaaatttccaaagaacctattttcagtcctttcatattcacattctaaaactggatctgaggatgcctgaggtcaaattttgcaactgctcctttctttccgaacgagatggaaggctcgtgtcttactcatcctgaatctttaacatgggcaattatctgagggtgtaaatgcccaggtgccaaccaaagggagaattctaaatatcaggggcagaattgagaaagtgaaagactctgataactgagagataaatgattttataaatcaggtgttttcaatcttttgctgtctacaaaacgaggtgggacctacgtgtgttgtcagctgacacttcattacaaataacttgataattactaactgtaacacagtccacttgttctcaggacggaagagatttctagcccctttgcaggtgcagggccatgtcagtggaataaagtgtcactttcaggccatgtgtttaagagccaatgtgttaccttcatgctctccctcccctttggggacaaccatggccaggccacatattgagccacaagatggaagctgtctggatatttgaatcagtacaggggaagaatagcctgggagggccacccaagcagaattggactcgttatgagtaagaaacaaaccttggtatgataagcagtgagatttcagcatttatttgttattagaacaaagcacgtctgtcctaactaatacattactatatgacaacagggcgcattgcctcacgcctgtaatcccagcactttgggaggccaaggtgggcggatcacctgaggtcaggagtttgagaccagcctaactaatatggaaactccatctctattaaaaatacaaaaattataactgggtgtgctggtgggctcctgtaatcccagctactcaggaggctgaggcaggaaaatgaattgaacctgggaagtgaaggctgcagtgagccgagatcactccactgcactccaaccaaggcgacggagcaagactctcaaaaaaacaaaaataataataataaataaataaattactatatgacttttggcatataacttagaaggaatttaaaaaattgagagatattctataacaaaatttcttccattttcatctgttgctttatatgaacgaaattttatctatgaaaaagaaaagattagaattaaactttattcctcatgtcattgagagatgcatttctagttttttaaaatataaaacctattcatcaaaatttgtaatactttaaaaaattaattgaatgtcaataataattgtaacaataactcaatccaagagaaggtttgttttggtttggtttgcccccgagtcatatggttaaaaacatttttttaagaattttttgttcttttttttttttttttgtttttttgacacaaggactctgtcacatggactggagtgcagtagtgagatcatggctcactgcagcctctaacttctgggctcaagcagtcttgctgcctcagccttttgagtagctgggactacaggcatgaaccaccatacctggctaattttttaatttctttttttttgtagagacagtctggctatgttacccaggctggtctcaaacttctggcctcaaataatcctcccaccttggcctcccaaaccactgggattacaggtgtgagctactgaaccccaccaagattgaagtttatacgcatagttttttcagaggctgtgatatgattaatacaattctttgaatcatgtgttttttaaatgggtgatgctgtgtatcaaatgtttagacgtgcttatcaaatatttagattcctttgaatacatatagatgcgctgcggtagttttattaaaatatactgaaatagtaaaacattaaactataccagaaattatgttctttttagtccttcaaatttatgatgaaaaaatggtagatgtcagcttaaaatgtaagaaagatacacagttttacaaaattgttttaggtgatctaggaacaacaactgtttgaagctatatgcagatgtgattataaatcacacatgagagtactgttgatgaccctctaagggcatacagagaggagaaggccctaacatgtcttgagacctgacagatatcgtcacgtatattttccttcttagattccacgacagccctgtgagttaacaatcaactctgtttcaaagctgaggacactgaggctctaagaggttaaattattgacccagatcacaagaatagtcaatgggaagtttgaggattcaagccaaagtttatttgtccccctcccaaaaccctcgtttctccaatgaaagcagaacaacatataccatggaggctgggtgtgctcttgaggtcaaaacgtgtccaagagagaagcccaaggagaaggcaaaacttgggaggaggccatccagcaggaaggctctctgcgaagagctctgtgtgtgcagacctcagaggagcttggttttgttttaaaaaaggaagtcttctgttctgatatcaaaaccactcccgatcaacattcattccagagaacagcagtgtgctgtggctcagcagctttgaggctggcacccttttgcaaccccagtgaggcacgtttgggcggacagcaaacacaggtttggctcaagggtgcagtgggagatgcactggagtcagtgcttactaatggagcatcagaacaataagtcacaatttctgataacaaagtggttgttttgttatcagtaatgcattagacagcacataggacataaagtaagacatgatctgtcccagtggatttatatgactgatgtgcgtgattacactccctaattcccagatattgacatcgaactgttgtggcagattttgcacagtgagtaaacttcacccagggagtaaggcaagcacttggagaattaattcaccaagcagaactgaccagttgggttcagcagacggacgatgagtattcatttacgtctcccaattatgctgcgattattgaaagatacaaattattcagtagtgatttgcctaatcggattttttacaaactcctccacatagctcattgttagtaattcctccaatctaccttcccttctgtccccttgttaaatgtctcaatttaaattattatattcagatatttaagcataagagttctttaattttagcagtttgggggctagaacttaaagtaaccctaattttgttttgttttgttttgtttttggagacagggtcttgctctgtcacccaggctggagtgcagtggcacattcatggctcaccacagtctcaacctcctgggctcaagcgatcctcccaccccagcctcctgattagctgggactgcaggtgtacaccaccacacttggctaatttttaaaaaatttttgtggagacaggatctgcccattgttgcccacgctggtcttgaactcgggctcaaacagtcgtcctgtctcggcctcccaaagtgctgggattacaagagtgagccactgcacctggcctaacaatttttacctttgattttggaacctaatttcttagacttagccagcagcgaatgcctgatttcagtttatagggaattgaagataatttcattgtggaatcatattatgtaaacataacatttcagagtatgtaatatattgagagtgacccaagattataacttatgcattttctttctagctcttatcactctagatgtatagtcattgaagtactttgtctactctccttgtctctgtaattgatatgaaagataaggaatttttggagggcacaaacaagggggatggaaaattgaatttttcctgcagtcattttacaatctctgacatacatccattacacagcttgtctggaaaaatcctaagcaaagtgatggttattggccgagatgagaccacatagaacaagttgctagttgtaaatgtacttttcttagaaaaactgtatttactcagtagttgaatacagcgatgattctggtgaatttcctggggttcagcttttagttactttctagactaaatggttctactcgtaccttcccagtatgatttttccttttacgaatgagttcagtattctgaagctgctaattaagaaacacctgtttaatttcccttccttcagaattcttaaggttttcaaaatccagattgtgtgagttgctaggctaaattgtcttttcatatctcctctttcagaaaaatgaaaatatattattttctgattcaaagggagcacctagagtggtaccaacctcttcaatcataacatggtatttttgctgagtgtaggcctgatatcctatggtttaacttcagtttccaattttaaggacagaaagatgtgatttggttcaaagcataatgaaggcttattgtagtaatagtaacaacagctgttcattggatgtctgctgtatgccctgtatgtaaatatcgtatctcattaaaaaaaaaattaatcacccgggcatgttgactcatgcccagtgctttgggaggctgaggcaggagcattgctcgagcccaggagttcaagaccagtctgggcaacacagggagactctgtctttaacaacaaaaacaaaaaaaacgtgccaggtgtggtagtgcatacctgtggccccagctgctcagaagggtgaggtaggaggatcacttgagccagggaggtcaaggctgcagtgagctgagatcacaccactgtactccagcctgggcaacacagcaagaccctgtctcttaaaataataatataataatcataataaccaccatttaatcatcgtttttaataaacaagaggccataaggtcagtattatcccctttttgcagatgaggtaacaaatcaaagcaacaagttactttcactaatcttatgcagttgattacgtgggttagttttgaacccaggtttgtcttttccccaaagagactttcaccattttacttattgagatgatttatatcgcagaactgtttttgatttttaaaatcatgttgtaatttcttaatctggctgctgctgtagtgaatgcagcctaacgattggtcaccttttggtagcagttcaactccacctttaccacttagtcataatgttttattactgttcattgtaaacgatgttcttttggctcttgtagaaggcaattacagcaggtaattaaaattgtagttctttacaatgtgtttgagaatattaaatcaagcccacagaaaatcaggtaaagtatctgttaaagtgaaaggccacttaacaatgctgaagaccattagcaaatccagagtgctatattccctgcttttccaagaacacttcgtatctgagatgtaaagaaatggaatttatatcagaaataataggaaccagaaatttatctggagatgtagattctttctgtgtgttctaattagtgagttcttcgcaatagtctctctctctgattctttgttatttcaggtaattattctgcctgcacccctttaccttttatgatcttgaagaataccctgtttagcacaaaattagttccttccaatctagtatacctctatgtttggctgagagggtcttaggaaagtataagaaagcctgtgacctctgcttgtcagtgtaaactgttattttgcccaggaataactagcaagtgtagctttttgagacggataccaaagatattattttatgtagttttagagcatcataaaaatgtgagctgggaattccctagctcacctcagtattaggcctgcatgaccatctgggaagtgtgaaggctataacggttttgtggtttttctagggaggaagatacaaatgtcaaaactggaagtgcggaactctagagaagctcttaaaagaatgaaggcttttccattttagttcctaagtcgaacttaaagagtaggagtcagagctgacataagtcagtaatggcgagcatccggctggccccgtgcggtagtttgctgtttcactgatgatgtattttgttgaggtgtgtcccatctgacattaacggccatgtctggtattaaatgcccttctctttctccaacaggatgtcactctgtggttctattaattcagacagggttgaatttcacaaaggcttgctttcatttgggaaagttttcagcacaagtgtactccagaattcaaacttcttcctttctaatccttaaaacattgggatgtaaagaaatggaatttatatcagatttatatatatcagagacttatatcctcattagtcagaatgatgtaggaatagaaaccatatgcataggttgccctttggtgattggttcatttccgaaagcttaaggagtttcatacttcgttagcctactcaagaaaacttcacttgtcttgaactgagaaaatgccacatgcaaaaatggtaccatcatatttgaaaatgtatgaagcgaataggcagtattctgagtcttttgtttctttgttcattttacttacagtgtttgtaaaaaccatgacagcatgttcttgatgaaaatctaggaagcagttctacttgaaccctagcctggcattagatgacctggatcctattcacctcttcagtttgcacttgaaggatggatattaagccatgttgcccccactggcctccattttgattggctagtgaccctgccatgttactacagattttgaatatcatctcaacctggaaggatactgagggatgcatataagagtaaacttattatagagggaaacagctggcatactggcatcagcctacaccattttcaatgtctatgtagaagaaccaagggaagggttgaagtatgattttctttggcttttagagtctctgtctcacttctgtccctaagtgtatgattctccccaactccctgccctttaaacactcagactacagttctgctattccgctcagaaaacgctgagcgtctgatacttatcaggcattacgcttgatgccgaggacacttggtgaatatgacatgtggttcctgccttccctgagctcacttttgccaggagaggctggcgcaccaggaaatgacaggaacacagtgtgttaaatgccacacgaaagggagttgtgtagaagaagcttccgaagcacaggcaagggaacgatgaattctgcttccgatgctggaacagctttgttagcagaactctgaaaatcttttctttcacgtatggagggatgcaccagcagtgagatgattaggaaaagggggttggggtagaacagcactgtctatgaccgggaactgccataaccaccgtcctttcatttgctcccttgttataaatatcagtgccccccaggaagactctgcatttaatacaaccccattccaagagaatccttattgataattgtttttcatcacccactagaacgtaagttccgcgaggatagggatttttgcttatttccgcaagccacgggaagagtgcatgacgagtaataagggctcagtaaatacttgtccagtgagtgcatggaagcctgtgaagtgaggcctttttaccctccctttcctggtcccctctccgtccctggcatctgaggatgctgctcaccggcttgttcttcctgtagctccttttcttttggtgtttattgctccttttggctctcctcgtcccaagatgtgaggattctccagcctttagtcctttggtgcaatgttttcctttgtttttctgcctctcctttttctccttggagatcgcactcaagactcttgagacttcacatatcacagttgatcaaatgttatctctaggcctgaatagcagcctgggcattcaatctttggtaagtataaagtaggacaagtgacttgaaggtcactctgactctaaaattctgatatcttctgatgtttgagcttctttgtctgacttagtaaggtgcccgaagatagaaggcgtgtccacatgcatttcctcaattatcgactcatgtttcttctgttttatgactgcatttgacctgctggttgcgggcgtccctctttgtctcagtcttactcatcaaattaatcatgctgcttctggatacagtggctaaaccttgccctgttgaacctaatatcagggacagtgtgccgtgagatgggctttactacgttgctggacactttcacttggaaattaaattaacctgcctccgtatactttctatcccaaagctattttttctcctaagttccctaggaagtcctctcaccccccttctatgttttcagctcttacctatcctatcctgaactcttagcataagtccctgcttctggaagaatattcatctctctgtccatctgtgcattcagaaatgcattcattaattcattgactcaagatgtatttactgagtgttcactaagcattataggcattgaggatatcatgattgaagcagactggtttctactctcagagcttttgttggtggaatcaaaagacaaacaagcaatttcaatatggattgggatgttctaagtcagggaatagtaattttcccacacatcctgagtttctgccacttacattttcaaacctttgcctgttttaaagacaggattgataaagacacagtaaggtcaagacacacaagattgtaggctgaagaagtgcttccttggaaagacttcacaatagctcttatttatatgagtattggtataggcttatatagagaaaatatgggagatttctcagagatggactgtgttataaatagaacaaatcagtcaaattacagctttcaagccacaggcctcattagtctcatgagcagggccctttgtgggcaaactgaatgagccacgtggaataacactcgtgttcatgttttgcaagctcaacatgtcaaactgtagtgttaaaatgagttgctttacaaatgagctataaatattagttctgcatctccaagccattcaatatgcaattgtgaaaactgatatccttataacttatgtataagtcacatatataacttatacacatatacataacttcaatgtacgagtgagtaaaaagtacggcattagtcagtttgagttgctgtacaagatacccattcattaattcattgactcaagatgtatttactgagtgttcactaagcatcataggcattgaggatatcatgattgaggcagactggtttctactatcagagctttggttggtggaaacaaaagacaaacaagcactttcaatatggtttgggatgttctaagggaacatgtagaagcaacaggctaagattcagaaacatttctctccaaatgggaagttttctaacacaaacacccaacttaagaacaaagaggcaacctctcatccaaaaacatctgcccctcacattgctttcaatatgcaataccttaaaattccacaatgagtattttcccaaaacaaagaatagaccctccacaggaaaactcaagtctcttccttaggagactgggtgacttaaacaacagatgttcattttctcagttctgaaaactggaagtccaagatgaaaccagctttgccagccaggttggtgtctcgttggggcctcccttcctggctcttagagagccacctttccactgatcctcacgtggcctctctgggcattgggggtgcaggaagggaggcgagctttagagagctctggtgtctcttccgcttcttataaggacccctgtcctcttgtgttagagacaccgcatgatctcatttaacctgagtcacttccttaagggccctgtcttcaaatacagtcacaatacaggttagggctttaacatagtaatttttttacagctcagtccataacgacttacacatttcttattcctattgcattttctttcctaaagtacagtatttctctagatcagaagacccgactagacatttgtggcctggatttgctccttgtgttttatttagcccacacaataccttaaaaatacatgagccaatatttaacagctgggagaacattttccagcttctcttaaaatatgtggccatgctaggacccctttccccagtttaaacagtctgtgcattctcctaaggaagagacttgagttttcctgtggagggctctattctttgttttgggaaaatactcactgtggaatcttaagatattgcattttgaaagcaactctaggggcagatgtttttggatgagaggttgcctcttcgttcttgaggtaagttgggtgtttgtgttagaaaacttcccatttggagagaaatgtttctgaatcttggcctgttgcttctacattagctggctctggaagcatttgaggtatgacccatgatccaataggagttgctgtgatgatggaaatgttctctatttttacatggagctattgaatacttgaaatgttactgttgtgactgaggaagtgaatttataatttaatttaaacttttttattttggtaacctcatgtggctggatgctactgtattgagcaggacagttttataaaaatgcatagcattttgcatacaaaagggattcctagtcaaactggccacatgacccatcattgagctttattcgctcctggagtgatctaacagtggtaagagcttgtcctgaccaggaagacttggactcccaggtccccttgagagcccttgcacatatgagcaggatacctccctgtattttgtatactgaagatccatggttggggagccctgtgtgctgggagacactcccttagcaagtatagccgcttagtcatttgccaggctgttgcattgcatgcattcatggtctatagtagtctgtattaatgagaccccgaagagatggttggtacatagcctgcatggctgtacacagcaatccggattaattcatcagttatgcccggtgccaggcacggaagttagggaagtcaagggtgagatggtcatctagatgggtgactaaagcgaaagtacctgagccacggttgagagaagcacagtttgctctggaaaacccagcatggggcacccagacacatcagtgggaattggaaggtttcccctgagagacgatgtttaactgagacctaaaggttgagtaagaggcagtcagctgaggcattgggaagaggtcatcctggcaaaggggagcacaaggctggagtcagcaggtgcctctctgttcacagacttgcagctcacctgctactgtagatagaaacaaagccctgcttggcagagggtgcaaacagaactgtctatgaccagcctctggaagttcagggttccacataaacactgatggtccggtgttgccagcccccgtccctgaacacagcgatctgagggagctgatgggatgctgctctcaactggggcatcacctcatcctgctcaggtctcagcagttccaagctgtgtccctcactaggagaccatgcagtgggtgtcgatcaaaatgtttgcactcttgtctttcttatagtagagaaatcctttaatataaccaagtctctatcaaaaacagggaaatataagttagacaatgaaggaggagagtgtctctgactgccccatcaagttattgatgttacctatctgctcgggccctgaaggcattcgtttgggcagaggcacgtcctgtctgctccctacaaatagatggtgttcatctagagcagggatcttcacgtcaggcctcagtgactccaggggatattcagcagtggatggttctcagggaatccacatcctccatttccatgtgtactctttcctgggatggatccgcctgagaacacgcctggggtcttccctctcagctgtcctttcacgcttgcttttctccctccttgcaagggaaaggcattcctcccagcaaaccctcctcttccttgttgcattgctctggcctgtagaaccctttgctttccagacagaggagaatttcaaacattagggtcggtattgagaaagtggatggctttaataagtgggtaagaaatccccttgcgagccagagagcttagaattcttggttttcaagagaattgaaggtgaacccaatcaagttgtcagccaatagatcattaaaaataatgtttgatgataaatcactgagtgacgatgggcataacagaatgctgtcgaggaattgggtgaaattgttaaaactgttaaaactccttccttcccatctgtttatttatgaaaataagttttctccatgcatacatttataaaaacaaaaaaatagaaataaaattgatgctgaacactttttcaatttacctagaagtaatatccatccatgaatatatgaactaattaaaaaaagaacattcccatttatctcattgagatgtatttccagtaaattttacttttcttattcaataattatttgtcacaatgtataatgatgtgtgatggtttgattaattgtgaatagcaattatgatggataatcaaaccagtttttttaacatttagttttagagtcacaggaaattttaaaaattattgtaatatctgtctttttgctataaagaagtgtagtacagtgataaagctttcaagcttaatatatattacatcaaataaaactctgaattgaaggagaagaaggaatgatgtaaaatttgcagttgttaaaaaggagatttttaaatggtcattggtaggtatcaaatcaaagtggtctctgggtccctccgtatgatagaaaagagtgacctaaaattttacagtacactagaaattaaaacacttaaatgtaaacttaaaatatgtgagagggacatcgtttttcaaaatttttatggagtacctgggcaaaaatatctgaaggccatgttcagtgaaagtggtaataagaggcatatgcgtaattttaaaccaaaagttgaaacagagtgggaggagcggaagaggagggggagaagagaacatgttgggccaatatatttaacaataatcatcaagaaataggaaaagacaaaacaaaaatcttttaaatatctaacactgttttttctaatgctacatgcccatgaaaatcacctgggctgggtcaggactttgttttagtcctcaggtgattttaatacacagccagggttgtgaattatcggactaaactcacagagtggtccttgggctagtactatcagcatcatcctgggaacttgttagaaatgcagaatttggggctccatgtcagccctcctgaatcaaatcctgcatcttaacaagatatttaggtgattcatatgcacgttaaagttttaaaaaaccaagatttccaacaagctcccaggtgatgctgatactgcggttcacggacaactctggtcacggactacgctgggtagcagagttctcgagttgtgctactcagaaggtttatggcagagctactcgcagtatgatccgagaatcgcgagcctcgcctgacttggattcacattagacatgaaaagtcttaggacccatgccagacctagggatcgggacctctgggagtggggtccaggaatctgtgttttatcaagctctccctcactaaaatttgagaaggaccaccctagagagaatccacatcgacttcagatggctctgagcctccagttaatttagggagtggctggggatgtgttattaccaagaggccccacttcatgagagagctgctgcatgtgatgagctccctcatcacagcctcacttgtctccaatcccagggatgcccgttttgcagtgggtctcgaatgtgtgaccagttttacacaggagtgagctgacggtgccttgcctctttcctcgtaccacatgcatgtacagcccttgggcactgcacctacccatgtatcaggtgatccagaaggctgttagtgttgaggggggccgagacccagagagggctgtcaggtggatccaaggacaacttcgcagctgtttgcattgtttgatccagcagaacggatggtgctggaggcatcctttggataatgattctgtgtgagtcagtgcaagccccgttgcagagttgcagctcagggcccaggagttctggagcaaaaccatttgcttggcagcacagaactgcgtattatttgagaaggactaacatcttgcgctaatgagtttctgggccccagtagacactgagctccaggtggctagaaccagaactgcccaccttaggtcaagtattatcagattatttttttctctttttctttttttttttgagacggagttttgctctgtcacccaggctagagtgcagtggcgcaatctcggctcactgcaaccttcgcctcctgggttcaagcgattcttctcagcctcccaagtagctgggattataggtgcccgccaccatgcctggctaatttttgtattcttaatagagatggggtttcactatgttggtcaggctggtctcgaactcctgacctcaggtgatccacctacctcagcctcccaaagtgctggaattgcaagagtgagccactgcaccaggtgttatcagattctccaagtcataaggatggccagatgcaagaccgacccattgggtggtggaaataaagaagcaaattacatgacaggtggcctcagactactctgatgtcacccacctctttagtactgacacctctcctccacctccatggctgtagcctcaggggtaagggatccttttaaccagctggcaggaaactaaaaacttgggactaactcacagatgggtcagaatgacatgttggtggcagctaaaaatgtagttgttcaatactgtccttcccagggctggcctgaatcaccaggggtaatggaagtcccttcagtgggcagagatgtgagcagtacttgcaccaccatccccactggcccagttgtggagttatccttcctctccccagaccttaagctctgctgtgttagagtcctgcatcccgggagatgatgcctccactggagaatacccaagggtgccctggaccaacagtcaaagaagtcaccgtactggcctgggtactgggtcactgtgctggtatgggtagtggatcactgtattggcatgggtactgggtcactgtgctggcgtgggtactgggtcactgtactggcatgggtactaggtcgctgtactggcatggtgaattggtgccagtgaccacgaggtgcctgggttgctgctatacagtggagcagaagaaatctgtctggaacccaggtgactcgccaggtgtcccatggtgctcccacactggtatactgtcagtggacagttgtgacgaacaatcgtgagtccactaaacactttaagaagggtctggggtaccatgacaccagcaccctagaccagctaaaatgctggctaagagtgggagggttgtgctccttttctccctcacttcttcttcacgggaattccgcttcctgataatgctgaacccaggctagggcagagctatctgaatctgtagagcaaagagaagacagtgtctccacagagtcaagacatttactatgacatctgtggctccagcgttcaccacaatggtctctttaggaaaggattcccagaagaacatgtatcggccaaggagaagacggtggctcaacgcacattctcatttggcgaaagtgcattgaacaactgcctaacgcccgtcagtccgtctggacttaggaaaacccatgtgtaatgaagagcctgtggccgcttagcattagaggaatgtcagcggctcagggcagcacagctctttctcggggccctgatttatggaaccctgggctttgctgaactcacaggcatggacaccaatcttaagctgtagcatgaagcctcgtggtaactcaaaagggaaaacaagaaccactttcctcaactgtttgtaaacttatattagcttcagaattctgcataacgtagactcacatggctttgtctatgtgagtgggatttgaagccaagttgaatctcctggcttcggattctctattttgtaactgcagatgggatatgatttattaactttgtcgctagctatttgaaaaaggagctcttactatggagaagaaattgttacattcctatcacccgcaaaataggacttgactctttcttcctcaaattaactaaagtcaacctgttttcaattggtgatattccttcattagttttaattcatttttcagcacacctgattttttaattcattatgcttttgatggaaattaattagtttcttttagatctaaaacaatattattgtgggcactcagacattgttacacaaaagggccttattatgaagctggtctcagaatgaaagcctgggtctgtttcataggaaactcgcctgacgatgaagccatcgggacgctgaggctttttggctgcctggttctgagcctcagttttcccatctgtgaaatgaggagcttgagccagatgaactctaaacttttgtttgatgagcacaacaaaatgaaataaaatcttataaaatagatatatgaagatgtatatgaaggtttatggtaatattatgttgatcaaacattttcttagcccaatagagaatgaaaattaatatcctactacaactttgcagaaatcctatttatttatttattagacagagtctcaccgtgttgcccaggctggagtacagtggtgtgatctctactcactgcaacctccacctcccgggttcaagtgattctcctgcctcagcttctcaagtagctgggattacaggtgctcaccaccatgcccagctgatttttgtatttttagttgaggtggaatttcaccacgttggccagactggtcttgagctcctgacctcaggtgatctgcccacctcagcctcccaaaatgctgggattacaggccatgagccaccgcccctggcccagtttaataattttagaccgtattgccaattatttaaaggagaagggtgagtttgtatttctttaattaggtttaggtaacggcctagggaaaacgggaattgcttacacagacaggtgaggaggagagtactccatcagacccaccctaaattgaattaagactcaggacccttgatgtgctcagctggatgggccttggatgtgctagcctggctcccagggaactgtcgagctgggcacccacagtgttgctcatctgccccagatggacaactgcctgtaatttaatgtcttttccaacagggagctatgaaactgaattttactacaccaaagaaaaacccgcttccctaactataatttcaacaaggaagagtttacacagaaaaatcccatttaaaaagtgccacttaatgtaatacagacagcagctctccagcccgagtgccacacagagaacctcactgtttgcccaaggccttggagacagaagtcagacctgtgagcctctcgtgctgctgattcagcctgattaaacaagagccctaatttttatcaaatgtgcagtttggtattcacaatcctttatgagtagaacctcctgaattaatcaaacgactggttaccaaataaaatttttttcaagaaaagagcttatgacatcatactttattagctaggatgtatgtttcatcagaacatctgtcatcacacaagagacagagaatggactacctgaaaaatctacgcttaactacctggagcagagaggcaaagtgggtcagctgcccaaaggtgcagcttcggagagcggaggtcgcgagagccaggttggcggggagggatgctgggtggtgaggctgggccacttcagcctggagggtgagggcagagccaaaatcttaattgtaggttgttaaccaaacccattgaaagagaggccaggtgcggtggctcacaccttcccagcactttgagaagcccaggtgggtggatcacaaggtcaggagttcaagactagcctgaccagcatggggaaaccctgtctctactaaaaatacaaaacttagctgggcgtggtggtgcatgcctgtaatcccagctacttaggaggcagaggcaggagaatcgcttgaacccgggtggcagaggttgcagtgagccgagatcgcgccactgcactccagcctggtgacagagtgagactccgtctcaaaaaaaaaaaaaaaaaaaaaaaaggccctagagaaaagagcaagatgtggagtggccaggcctgaaatttgggtacgttaggcaggccagcgagactggaaaccaggtaacaaaagtgccctaaaagccactcttggctcagggtctcttcagcagtgggctccctttagcattcagagagaattctctccacgtgcttctccttttttttttttttaaacaaatgcagcctagtcaattaaaaagaaattccatttgcagtgtttatttaacactgaacaggttgcttgctgtatgaaaccaaaataataaaagtaaaataaaatttgagtgaataaattactggtacatttagaaagcggatgaattggcagcataaacagattgaaactgtggtttctagaataaattcagtagaaatgaaatttgatttgagctgctctgctacctacaactttgcagaaatcccatttaataattttagaccgtattcccaattatttgatgcagaagggtgagtttgtatttcttgataacacatatgtatttctgtttgaagtaaatgagagtaacttgcacataccagaaggaaagtgcgtcccaggaattttattaactatatgtttaggttgctgagaaatgacattctctcttaatttcatgaactgagtagtaaaagagctcactggggatgtgtgcccaacacatgcatgtacacacacacacaggcaaggaaaaatgtgctggcatatccttttgggtatgcagttaatatactgtttaaagggatctcaataaagatttcctataaattatgtttattgcatgaaaataagtagagtctaaggtgtgcattctaaatgtgcttggggaattccagcctttgattttaaaaggagaaggacatttgtttaaggaatttgattatctactgataggtcatttctgaaaagaatatggcacattcatcttggatcccagtggaggctttactgcggactgccttccccaaggccctgctccctgcacacctcactctcaacagcctcctggttctttgcgaaaaggaagccatccaccactctataaatcctctctaaacatatgtatgtggactcattcttatttacctccctcctgtcctaaagagtattactgcttccgttgaaggctaaaatttcccccacttctctgaactcatcttttccacaagcttggctctgttcttgcctttatctggaaccctgtgagcacactcagcacatttcctagacagccgtgtctttacccctggttcctatcaggagatccccttctcctcccgctacgaggggcagcagcagccctctcccctctccacgaccctctttagtctggctgctgcttgtcaggtccgcactggaactgcccccagcaggtgaaaggtgacctgtccatctccacctgtagaggtctatgttggtcctcatcaccttggccctactgcgcggctggctgtccccagtgccaccccagtgttctcaggttttctagtctctgacagctgccgcttagtgtaatcacgcttctttttttttttgctttcccattaagcattgttcttgtggagagctgcaatgcctccagctcttctctgttcatgcctctcacgtacacctgaaacctccaaaccctgcctttgcgatttcaacctttactcctggaactcacatgtgtgccctgctgtctagatgccccatggactcctcgatgtaccatcgacttcatcaagttcattatttcttgcccagaccagttcctctgtcactatcgacttggtcgccataaacctagaaatcctgggatggtcttaaattctttccttcttccattaaatggccagattttcctgattctatttctaaaaataattgtaatttatttagtatttaccgaggcctttaacaagctatgctgaggcagctgtctgacagaggagactccttatggccatggccacaagagtagtaagtgacagaaggaggattggaagcaagcgtgtgggattgcaaagccggccttcctcctcttgcctgcttctcacgctggtctttgttgacgctgtcatgctctcattatctctcactggattaatgctctcagatgtttttgctactgtttatcctaaaggaatttttgaaagccgtgtgtccccttgcacattttaaaaaggatattaaattcattttgtacctgcaaatagttgcaaggaatatttactgtaagtaatcacattttaaaacaaaaccatgacatcattcttctgaatggagcaactagaatatcccttagatgacaccattttctatttcaaaagtatgtggaaaacattttctttgacagttggaggtggtgctgatacactattgcactccgctgcacccctcccagaattagaccctaatataatgttcttttatgcttgaaaaacagttattaatcatactatcgtactttcctgcaacatacgtatcacatctacccatacacacatgtgcatatgtgcacaagcacatacacatacaaaccgtatttgaaatgtgcttatttccagtgaccataaacttaaaaaacaaattccatctcgagctgttatgatgatagttcttatgacacagttgatcaggattctataatatattacaaacttcataaataattattaaacctataaaatgttaattggaaacgcatctcttaacgagatggattcaggggcatttatgttttggggtcctgatgaaaggaattccagttgttcctttgttttggtacccagaaggatgttattttaaaaatcccttatcggaactctccaagcatcttcagcacttttcctgacagtcctgtcttccttacgtccttcagatgcaggatgacaggagccttctcttgttaaagtaggaggagggtgatcgtgaaagggaagttgagagggagtagctggagtcaggcaggcttcttgagcaggcagctttcagaaggaggacgcatggaaggtggatatctactaatagaagttgattcccttaaaactgcctgtgtttgaaaagttcatagagtacacacttagccccaggggaacagggaacatagaagaccaccacccaggccacgttctgcaatgactatagagttgtcttttcttttttttttttctgagacagtgtattgctcttgtcactcaggctggagtgcagtggcgcgatcacggctcactgcaacctccgcctcccgagttcaagcaattctcctgcctcagcttcccgagtagctgggattacaggcgtgcgtcaccatgcctagcaaatttttgtatttttagtagagacagggtttcgccatgttgaccaggctggtctcgaactcctgaccttatgatccgcccacctcggcctcccaaagtgccgggattacaggcgtgagccgccgcgcccggcctggagttttcttttctaaatatgccacttctcttcttccggacccccttgaggcccagcgcatcagatcttcacttcctggcctggtatttaagacttttcatacccgtcctttctctgtttagagtttccatttgccgtccgaactttccctttcaaaggtttccttttctctccaaatgaatgcacccctcctctgctggactgttcttgaacaaatcccctggcctggaatgcgcttgtactacatgtcttcaggatgctccagcatcatgtcttccccggagatgcacccactcctggctcattcactctttatcttcaccactcagcgttgctgctcctgccctgcctgctgaggtctgagctcctttcctggcaacactcccctttcgaccttgtatccttgagtagtgcaaagcccaggacacagagtttagaatggaatttgtatagtttctaatggcaagaaattagacttcctggacatttgtgggaacatggatttattagtctttaggaaggtaatttttaaggaaaatttgtttaaccacttcagtatatgttcaatggttgagagggtaatttttgacttcagagaatattacaaggaaataccatgaatttggaagatcctgtgagccttattctgactagtgaatttcaatttagagcaggccagagaattcattttgatggatgattcttagagggcggcgtattttgataatagattggaatgttgctgatagctggccattgcctgtgttacaacaagtagtcttttagttagcaggatcatttgtttattttcttgttactgtacctatctgtgtaacttaggtctttcttaaaaaagctgttccaaagctcacgtggagagtttgtgatagaagagttgacagacctttagttatgaaggcagtgcttggcctcacaataaaatattagcttggctggagagagaattcagaagtttggaagaataatatgtattttcataagtcgaaatgaccaatcattcacaagttgagaaaggacttaaggctcagtagagtttcttggagttatgtaacatcagtcaaaacttggaggatgtaggcttctatacttacaaggtattttcttccacattgctgtcctgtgacaaaagccaggtaggagaatgaagagcacctgccctgggaatggacccaccccccttcgagtctggccctgccactcatcaggcacatggctttggcaagctaagaagccttcttctctgcatccaatcctcatctgtcaaaggggacagcaatgctatgtatctcatgagaacatttaaagtactaagtaaatatatggaaagcatgtgtaacgttgcttggcatggagtaaggggtgacttattttactcttttctggaatgaaaataagatgccttttacactgttggtgggactgtaaactagttcagccattgtggaagacaatgcggcgatccctcaaggatctagaactagaaataccatttgacctagctatcccattactgggtatatacccaaatgattataaatcatgctgctataaagacacatgcacacgtatgtttattgcagcactattcacaatagcaaagacttggaaccaacccaaatgtccatcagtgatagactgcattaagaaaatgtggcacatatacaccatggaatactatgcggccataaaaaaggatgcgttcatgtcttttgtagggacatggatgaagctggaaaccatcattctcagcaaactatcgcaagaacaaaaaaaccaaacaccgcatgttctcactcataggtgggaattgaacaatgagaacacttggacacaggaaggggaacatcacacaccggggcctgttgtggggtagggggaggggggagggaaagaattaagagatatacctaatgtaaatgacgacttaataggtgcagaacaccaacatggcacatgtatacatatgtaacaaacctgcacgttgtgcaagtgtaccctagaacttaaagtataacaaaaaaaaaagaagacaccttttattatttctaagcatcctctgagttcttgaccaaacctgatggtgcaactaaataaaccccgtgcatgcatgattagtaattcaaaattataccctacgtgttggcattttcacttgttggagtgaaaattatcattttattaaaattcacttaaagcttgttgaaagcaggcagagatgctatctgccccaaataataagcttttagagacaatgtctttcttgaagacatgatatagtcttttttaattgaattatttggcgttattaacattttaatgaaggaattattctattttcatatttcttagaaactaatatttaatttcctttttatgttaataatataagtatttagcatatttaaaatctcagttaaaactaatttatacttatattttcataaagatagaagcgtaatatgcttctttgcattgcgtgtttatgttcttgctttgtccaagttttcccttttccttagctatattttgaaaataccagtctcaagggaataataattgagatcagtaatatcttggatgaaaaagcttgccaatcatgccggtgttatgaggatgtgtatttttaagaggagacttactaagtaagattcactggcattgggcggcttgatatatgtgatttatgggaacacctttcagtaattttacacagtccaccagaaaaccttcctcataggtagaaatgaggttgaacccagaagaaacggcctttggaaaagaattggacattgaagctaagcggctaaatagcttcagacatccctagaggaagaaaaataagatttaaagtgttattattaaagaatatgatctataaataaaatggtatattctcatacccctgacagattttgacaaataagagaaaaatgtgtgcttaataggaaaaatgtgtttgaagtatgttttacactatttaatgccgctggtgcactgagaggttgctggtggacttgatgttgagttaatcttggtgaacaaatagagaaggaaggattgcttggcgctggaggtctgctttgtgcagagcagctttgttgacagtcaaattagaggaccggcctcagtgccagttctcagcacctcgcggataatgagctttggacgagagtgtgggtctaggcttttttttttttttaacttgagattctttaaatcattttgaaattttgattttaaaaatagttctggctaatattccgtagaagtatagaaaactggccagccgagagcgacggatggcaccaggcctttgaagggtagcttgtgtgtttggaagatatgtgctgcattgctgtgggtaccgtgctgtcactagccatcaccactgccaacacatcagtttcacgagtcttgcaaaaaatgagatttaaaagtttatttaaatctcatttatttaaaagtttttttttggccgggcacggtggctcacacctgtaatcccagcactttgggaggccgaggcgggcggatcacgaggtcaggagattgagaccatcctggctaacacggtgaaaccccgtctctactaaaaaatacaaaaaaaaattagccgggcttggtggcgggcacctgtagtcccagctactcgggaggctgaggcaggagaatggcgggaacccgggaggcagaggttgcagtgagccgagatcgcgccactgcactccagcctgggagacagagcaagactccgtctcaaaaaaaaaaaaaaaaaaaaaaaaaatttttttccttgaaatttgcttttaaaaacatgccatttcaggaaagaaaaatatgtttctttattctttaaattcttaaattccatgtacttttgccataatagtcacccacccccagagtttttctgagagaatcatctcatatgggtgcagaatgttaccttatggtcaaactaattagctctgttttcctacctgaccgtgtggataagggagcatttgtcatttggatgatgctcagtgtatatagtcatccctccattccaggacccctgcatgaaccaaaacccacacgtgggaaaagttagttctccacgtacgcaggcttcacatcctgtgaatactgtattttcaatccacacttggttgaaaaaaaaaaatgtgcatagaaatggacccatattgtttaagggtcatctgtacattgactttccattgcaaagatggaaagtaacctattgctcagcctcgacttggacatggtttgtagtcctaagtggattctggagttcatttagtaaacaattttggagggcatctattaagtaccagctgctggcaatatagccataaacataactgtcctcaaggatgtcacaatccaatctggcctgtgttttaaaattattgtgtgtgtgtgtgtatgtgtttaatcaagtgattttaatattaaaaactctgttagaaaattttataattaaattttatatatatgcatttgtatgcattaaaataagagttgtatatcccttattcaaaattcttgggaccagaagtgtttccagtctcagatttttttggattttggaatatttgcagaatacataccagttgagcacccctaatctggaaatccaaaatcccaaatctgagatgccccagtgagctttcctttgagcatcacgttggtgctcaaaaagctttggattttggtctggcacagtggctcaggtctgtaatcccagcactctgggaggctgaggtgggcaattcacgaggtcaagacattgagaccatcctggccaacatggtgaaacctcctctctactaaaaatacaaaaattagctaggcttggtggcgcacccctgtagtcccagctactcgagaagctgaggcaggagaattgcttgaactcgagaggcaaatgttggagtgagccgagattgcaccactgcactccagcctgtcaacagagcaagactccgtctcaaaaaaaaaattttttttggatttcagagcattttttgatttttagattagggatgctcaacctgtatttttttaaaatgctttacacatttttaaatttgagagtatggaataggggttataacttctagagacaggatacttgagaaggatattatagatcttactttcttagaaaacttttaggagccaaaggttatgtacggtgtggtagaggaaccatagaggttttgaaatcatctgacttcagttcatatctcaactctgttccttcctagttttgtgactgagagaagactacctaagctctgcagaccttagatgccttatctgaaaatataaataattaatgtaacaatacataccttatagagtatgtgtgcagattaaatcagataatgtaactcctgcaacacagtagatgcttgctaaatgttaatgattgccccctgtctcatttccttacctgaaatctcaatactaattactggtgtttgttgttgagtgctaaaggtgatctgattagtatagggtcacagagcaaccatattccgtaatgccaacacgaagatctttcaatgagaatgaaatgcaatttttatatttttattcatgaaattttagagtcacataactacacttgaatgcctttgttcatgagaaaacatagaagtgacaatttagtatttctctgcaatatcttctgtaaacattgaaagaatatttgagggattttcgatcagatgtcagactgaagtaccttctgcagccactccttctcactccaaataatagaaacaacaaaaaagataggtacatagataacagaaaagatgggaagggatgtattatgaggaatcgctatagagaacagacaaagttggattgaaaagaaacctacaaaagatgggacgaacactagagttaggagacactgagagcagggtggacccaggtgcacatgcagggtggctcagtgaactctaactgcttcatctacagtgtcctccagaccctgtacgtcctaatccagccctgctgtggccacagatttgcctgcccacttgtgacagctatcagtatcaggacttaggcctaagagagaggtcacttttctagtgagctgggaggacagaagagcccttcactcccagaagatgatctagataagatcctcaagagcacatccaggtccttctctcactgcaggggatagacacagcagatattcttacctggaatctcaaatagaaagatgagcaccacaccaagaatcactagacagctggggaatgacaacaccatgaaagagagacacccactcaacaaaaaatacttatgcaaggaaatgctgaatagaacaagcagaagagaactacagaaaaggtacatttactattttaggagaggtgcaagaacatattgcatccattagaaatggatgaacctgtaaattaaacattgattgttgcaataaaaattaaacaggctgaagacaaaagtgaattcaacttgagaacaagcttagaaattctcctaggatgtatcaacagaagactaggagaaataatgtatgtaaaaaaaagttaatggacatagaagatagagccagcagtgccaatattcatcaaatgacaggagtttcataataagggaatgtgggggaggtaatgtacaaagaagccctaggcaattttccatagctgcagaaaggcaaagaggccattaggtgccaataaaagagaaacaaacaaaaaacttacaacacaatatactaaaagatcctggggtggatgtggaggctcttttagtcaaagttctgaggggaaaacttaagaatgtggaaatctgtgctgcctttcaagggtcaaaatgaagtgaagactataagactttttcagacattcacagtctctaaagcttcaattaatgaatggtgaaagaattaataaatgatgtactccagcagtaaaaaagctgcataaaaatgaataataaagaatttactgaaacttactgttaaatctaaatgtttattattgatagcattaatacagaactaacattccaagagttatcaaccagagattttggaagactggggagaagagagatgtggagtaagggaggaataaagaaaatgcatactaattttcttatcttgctcaagggaaggatatgcttattgattcagtctagatacaaggaaaaagtaagtttctgtaaatgttaaaaatttaagggtagctagtagaagaatagaaactgaattcatgacttccaaactactggagaaaaaaataatgtaaatctgatcaagaaaatatatgaaaagagggtttaaaaaatgaaacaacctagaattttggcaaaataagtgcataaaatatcaggtagttcaaatagattaataatctcagtaaatgtgactaattttgactaacaagactaacttcaacccaactctaaaggacagagcctttcaggtaatgttaaaaaaaaaaaaaaaaaaaaagcagctggccgggcatggtggctcacgcttgcaatcccagtactttgggaggccgaggcaggtggatcacctgagatcaggagttcaagaccagcctggccaacatggtgaaaccccatgtctcctaaaagtacaaaaattagccaggcatggtggcgggcacctgtaatcccagctagtcaggaggctgaggcaggagtgtcgcttgaacatgggaggcggagattgcagtgagccgagatcacaccactgcactctagcctgggcaacaagagcgaaactccacctcgaaaaacagctatgttatatgctacttataggatataaattttttaattgcatagtatgaaaacatgtcaaacattaaccatgttgattaggttgagcaacattaatataagaaaacttagaattcaaggtaaacagtgttaaaagggacaaagagggatatttcctgctgaaaaggaaggctctaccaagaaattacaaggcataatcagtataccataaccaagtagattgaatccccgaaaatgtaaggatggttcagaattacactatgaaaaaatcaactcctattaactgaaaaaaattactcttagtcacctgggtatagagggaaaacttatctaaatagaggaaatctaacaaaaatctactggaaacaacatactgataaattattagaagcattaagtttgaagtctgaatctggggaaagatgtctactattaacattgtactcaggacacagtcagtgcagcaggacaaaatggaaggggaaggaggaggagaaaggggaaaaagaaactgaaaagaaaaaggtatagatattagaaaaagagcaaactgtcattatttcaggcaatatgattacttgcgtagaaaacctaagacaggctgggtgtgacggctcacacctgtaatcccagcactttgggaggacatggcagggggattgtttgtgcccaggagttcaagaccagccttggcaacatggtgagaccccatttctacaaaaaataataaaagaaattaaccacgtgtggtggtgcatgcctgtagttccagcttcttgagaggttgaggtgggaggattgcttgaggccagaaggtcaaggctgcagtgatctatgatggcaccactgcactccagcctggccgacagagtaagaccctgtctcaaaaaaaaaaaatgaaagaaaacctaagataataaactgaatattaggattaatgagagttctgaagggtggctagatagaagatagatatggaaaaattctttttcctgttcatcaggaataagagaaatttaatagaaatacagtaaaataggaacataccattcactgtagcaagcaaagctattaaatatttttgaataaactgatcaagaaatagttaagaatctatagaactttaatgacgatttttaaaaggaacaaatagtgtgatataccatatacatggatggaaagactcaattatgtaaagttgtcacctctccccaaatctataaattcggtaaatcatgaaacttgtcaagatgattctgaagttaatatggaagccttaataatgaatggtttaaaccatagtatattcatgctatggaatacaatggattagttaaggataatgaggtaaatttgtacatatgagaatggctacacctccaagatacgtttttgtgtggtgaaaagagaaaattgctaaacagtacatataatatgatatcatttttttaaaaaaacacaaaagataagtcaggcaccgtggcacatgcctgtaatcccagctactcaggaggctaagagcgggaggattgctgagcccaggagttcaaaaccaccctgggccacatagtgagaccccatctcaaaaaaacaaaactgcaaaacaatactttatatattttattactacatgtatatacatctaagtgaattcaaaaaatacccaggaaaaaaaaatcacaagaagcttaacttcctttctggaaaggaaggatgaagactgaatgtagaaaaattttcaaaagggtatttgacccacctttccaagtcgtctatgtctgctttgtgtataagacccagggttttttgttgttgtgtagcagggggaatagggaatggtatatctgtaccatccttctaggaagcacaagtcccagtacaagctttaaaagtaagcaaaaaacgaaggaagaatttccctatcaggtgtcaaagtgtattgcaaacatcaactaataaatttgtgatactagaataagaatgagcaatagtgttgtttttggttatctagtataacagttgtcccaaaatttagttgtctaaaaccttgtatttttcttttttcttttttttttttttgagatagagtctcactctgtcacccaggctggagtgcagtggcgtgatctcggctcgctgcaagctccacccaccaggtccacggcattctcctgcctcagcctcccgagtagctgggaccacaggcgcccgccaccatgcccggctaattttttgtatttttagtagagacggggtttcactgtgttagccaggatggtctcgaactcctgacctcgtgatccgcccgcctcggcctcccaaagtgctgggattacaggcgtgagccaccaagcccggcccatatttttcttttgctcaagattttgtgggtcatgaattggaaaagggctcggcaggtgatggttgggggctcaactttgatccacctgcctagctgggaggctgggctggaggtctccttccaaggtagctcctcctggggggcctttgctcatggcttgaggctgtcattgcatgatggcatcagggtagttgcagttcttccatagtgaaatccacttatcaggcactttgaacttcagtaacagaaaacctcaactcacgctggttttggtttttttttcagtaaggtaattaaaagcaggctgtaggtgcccactgtggctcatgatgttgtaaagacctgagttttttctgtctttctgctctaccattctcagcattggcttcatcccaaaccaagatggcagctggcagcagtttggacatggtgcatcctgttacattatcaacagacaaagaaagtcaccccataaaaattccttctcttttgtcttataaggccaacttccattaccatccccaggggacagccagatgctcattggctgaaagtgattttcaggggttaagtcaacactgagttaccacactgcccaccacacctgtgtcactcacgtcacacttctccagatccattgcaaataggtgaaacatatacatgcaaaatacaaaactgtacatccttagaaaataatgacgtgtggggaagatcttttttaagaaacaaagttttaaagcaacaaaagaactgatagaaattttttttttttttgagacggagtcttactctgtcgcccaggctagagtgcagtggcatgatcttggctcactgcaagctccacctcccaggttcacgccattctcctgcctcagcctcccgagtagctgggactacaggtgcctgccaccactcctggctaagttttttgtatttttagtagggtcggggtttcaccaagttagccaggatggtctcactctcctgacctcgtgatccgcctgcctcagcctcccagagtgatagaaatattttattgcatcaaaatttaaaacctctatgtaacaaaggccctataacaaaattgagacaaaagacagactggaagaaaacatttgcaacatagtcaatctacaaagtctttttagaggtaatcactcgaaaaaagacaatgaaaaaaagatgggcaaaggatttgacaagaaggttgataggtgatgaatacatattgccagtaaatgcatgaaaagatggtcaagttgacttttcatctaggaaatccaaattaaggcaaactataaattttcactcaagttgtcaaacatttaagaagtttgataatatcaagtgttgagcagggtaaaaggataatggaattttcaaaatgcaattgatgtgtaaattaatacagccatttttgggagcaatttggtgatatctattgagaaaataacttttatttgagggatgtgagtccttttaaattatcaggcccagagagacattaaaatgacgtagcagtcatctcctcctctccccttggaggcctgtattcatctcttgaaactgctattttttgccacaagtagctataaattaacttgataatgccgcacctgacactgtaacccacaccctatagtttaacaatatgcagccaatcactaatcaatgtgattcctgtaaaccaatgagaattgctgaccaaaaaaacttgatcagcccactccctgtcccccactttttgcctttaaaaacctgcttgcaacaaaggccgaatgaagctcacatccaaggttaccggggtctcagtcttctgggcagctgtccccactttggctcaagtaaactgtctatattttgtgcctcagccacttccttttaggccgacacgattataatgatgaatgtccaagctctgtaacccttcagtctactgctgtgaaaaatagttgcacatgatcacagggagacacgcgtaagggtgtttgtcctcgtgtcaactggaaacagttgtaatgttcctgagaaggatgattaaagagcctattatgtagctaggatgcaatattatatgcaaaggtcagtgaagcgccgtgcaaaaagatcaggaaagacattgctgtcattttactctccactagttatttaagtcatctatgtatttgtttaagcaaaattcgcttgtagttccattcggtatctttaaagttgaagcatcttcttgcttgattgttttggtgcttgtaggagggtagtaatcactgtgcaggcatttttgggcttggggagtgcttgtgtgcttcaaactgaacagtttccactgaccccctgctgcttgggtgccaccaaaaataaatggaatgagtaatttgaacacaaatgggagaaagcacgactcatttccatactatggagaacttgaatgtcttcaccagaagggatgtctgttaacttggtgctcattcaaaaccttatttggggctaacacttctttataagctgtcttcatgagcctgaagtaattcaccaagattgatttgtaaaacattctgaatcaattaaggctttaatcagcaaagtagcaaacttcacatggcttgtggactaattttaccctctcccgtcaatgtgaacctaagttgaaaaaagaaaacaattaagaggatgtaattatctgtcctgattactgaattaaaagagtttgtgtttatctgtcccagtgtaaaggtggtaaacaatgccaggagctgtggcactccggagctcctacacaaaaacctgcagagcatcctagaagactctagtgaccctgccttaagtgacctggcagcaaacaaaggctgccgagtattattgtgtataaatgtttcccagagcacggtttgaaaaagctccttgccaatggtgggtgggggagtttcctgcagaaacatctcatttgaattactacatggacagatccatctacttacgcaatgcttaggaaattgctttcctttatttagaccagttctcagcagtggctgcatatttgaaccacatggcggagctttggaaagtcccagaaaacactcagaccaattacatcagaatgtctgggggaggaagcagggcgctagtaccttttcaagttccccaggtaatttctgtctgcagccaggattgacagatccctggttcagacagcatttccaggctggtgcagtctcggtctgtgttgttgtggcacagcgagcaaatcttgtgggaatagaatgatttttgacaatgtcttctttttggtaaagggtatgtgttaatgcataacataactaggataacttttgtaactttgtcagactttaatgtttatgcatcagaaagattcctttctcagataatgcttcctaattcctgagttggaaaaagtggttatctgaattatttgttaggcaaagcttgaatagtcagtgactttcacttagtctcttccttattttcacttcaaatgtcaggctttttaatacgtcaggctttttctgaaaaaaatttgagcttgagttactagtggtttatttgggacctctcttagttccatacttcagtgttccttagagcagccgtccccaacctttttggtaccagggagcagttttgtggaagacataaaacatttttcatggtgggtagggatggtttcagggtgttcaggcattagattctcataaggagcatgcaacccatatggatccctggcatgcacagttcacaatagggtttgtgctcctatgggaatccagtgccaccgctggctgatctgacaggagggggagctcaggcggtaatgctcactcaccagcagctcgcctcctgctgtgcatcccagttcctaagaggcctggaacccataccagtctgcggcctggagggtggggacccctgccttagaggatgagcagaggactgctggtgcaaaccctcagcctggttcctgtcctcctgagccattcacttctgttccaggctggattatctacttagcaagatgacccagactccttaaaggaacacagggaatgaatagtgttagccctgcttgcctcctgggttccttacctctcccaccaattgaattatcagagacctttccagtgagggaaattctgcctgaaacttttctccacttgtcagcatttccactgatgccttactgcccttttgagattggcaccccattgcctggctggcccattttattttaactgtggcaaaatatatatattgcataaatgttaccattttaactatgtttgcatgtacaacttcatgttattaagcacattcatattgttgcaccaccattaccaccatccatttccagaacttttccatcgtgccaaacagaaacgctgcactcattacaccataactcttcatcatcctccctcttcagcatcctcactctctctataacttttgttctactttctgtctctgaatgttcctactctgtgaaggtcatagaagcagaatgatacagtatgagtccttttatgactggcttctttcactcagtgcaatgtcttcagggttcatccatgttgtagcagttgtcagaattccttccctgttaaggctgaagaatattccatcgtacggatggaccccattggtttatccacttattccctgacgggcgcttgggttgtttctgccttttggctgttgtgaatctgctgctatgaacatgggtatacagatacttgttcgagtctgcttacagtttctttgggtatatacctgggagtggaattgctgggttgcatggtaagtcgatgtttagctttttggggacacatcatactgttttccacaatgatcacagtggtcacattcccatccacagtgcacacaggttccaattttttcatatccttgccagcacttaatttctgttttttgtttttgtttttgttttcataataaacattctacttagtacaaagaagtaggctggtctatttttcattcactgtgcctggaactggctcacttctaatatgtttacacatagaagaaaaattgtgtttatgtcaatttgggcagggatcaagtttacttctcttctccttacgtttcctattctgttctctttgtttttatagtcaatcatttttacatatcttttgctgtcattttaatggggctttgggagggaaagaaggtcgatatatgttgatagttgttgtgggcagagattcagtaaactgtcccttccctttcctgcctgacgtctccatctgttgaagaataagacaaaagggtaaagcagataggaagttaaaatattgtctttataactaatacacggatattagagatgtggctaatatctctgcaagaaagtaggtttccagacaacaaaaccagagctgaacttggccacccagtcttagacagccccaaggacgtgaggggcacagctgaccttggccgtccagtctcagacagccctggggatgtgaggggcagagttggtgtgcctcctgatctagcctgcttagtaacgggaaagaggaaggagccccagggaatacaccctgtttattgctcccaaattcaccaattagctcagtcacacttctttccccagtgagggaaagaatgagggagcagagaaagagggaatgacaatagtggatcactaataccagtagtgacgatagtgcattctctccacaaagaagaaaacagatgtgagtaagaagcattttcccccagcacaaatcctccatgtttaacagactgtcccatttgagcttgctctctgaccactggtctctcaggggtgctaactctgagcacatttcctatacgtttcttcagtctcctaccactcagacgtcttggctgtggcatgaggtccccgtgccctccagcacgttttactgacaggagtagaaaggaagggcatgtcatacccccatcttgggaagtgatgaacgtccacagagatgagattcataggaagccccatctgagccacagcagatggggcaggagggcccagggggctggaggttgtggaagcagggagtgtgggaggcctggtgatcctcctgaagaagtgagaatgggttggcctaaagggtgagttggtgggagaaaggagagaatgcagaagggcatttcatcccactccctttggagggatgtgggaatgtggagaggagtaagaccgacagactcaaaatgttttgacatgtgacacgccatttacaaatatgtatgctttgtaggcagaaatgaaagaatagccaccagatagaaaccaggtgtctattttccctgagttcttttattttgttttattttattttggagacaaggtctcgctctgtcgcccaggttggagtgcagtggtgtaatcacagctcaccgcagcttcaaactcctgggctcaagtgatcctcccacctcagcccctcaagtaactgggactacaggtgtgtaccaccacgtctggcttatttttttcttttttttttttttagaaatgaggtctcactgtgttgcccaggctggtctgaaactcctggcctcaagcctcccaaaacgctgggattacaggcatgagccactatgtctggcttcacctccattcttaacccatcagttttatggatttttcttctaaataacccaagatcactagcaccaacatcttttcagaagttattttgggctccacagggaaaagaagccctcgtagtcctacataaacacacttaaagtgtgtatttgaaaagcagagagagcagcagcggacctgctggtacacagatcagaaaggagatggggatgcgaaggatgagatgggattgaaaggaaaaggaggcagagtgacagaatacagaataaaacattatgaatatattttgttagttgactttttagctattttagaatacatgcataaagtcctttcagttcttgggaggctgaattctctcattcacaaccaccatattgagccttactttggtctcagatcacactgaagagctgattcacttatgcattcattacttcaataaatactgattgtgcatctctcactggagaggccccattccaggctcagggaattctaggacaaggagaacaaagatgaccctgctcttctgagctctgattccagtggggaaaggcaacaagcaagtcaacaagcacataactgtgatcattccagagagtgatctgtgctttgaacgatgaaagggggccaagtgattctctcagcagagagaacaagtacacaggccttaggaaggcgggacttttttgtgtgtagggaaagaaggccagaatagctgggttacagctcccaaggggagggcaggatgagatgatgaattttgaggagaggctctccagaacagtgcatgcacgcactagttttcatgcaattccacggaggtcgtggactcccctgcccctgcccataatccatggaccacagattaattgaaaagagagactgagcattgattgtgaggcatacagacaccaggctggttagagtggggaagtgtactgttcccagggcacaggaatggcatgctgtgtttagggatactggctgtggaggaaccacttgagaggaggcgtaaggacagactgtgaaggactttgatgtccaggctgaagagtttgaccttgaacccattagccatgggagctggactgccgagagaacacgtggcctccatccacagccctcagctcagtctccttggtaggccttaggctggtgaaatgcaccagctctgccatcctctgtccttctggcaggttaacaacaaagtggctcacatgtggaaataaacgtggctggtatgagtgggcgcaggccttcattccccgtgctaatggaaaagccgtatttttccaagtggtgctgtaaaagctaagaaaaattaagcttcaatcaaacacagaaaaagcttgattttaagttagattgaagtgaaattaaaattgaccttggccagttttgttctgaagagatgagttcaaactggccaaagaaaaaaataggcccctaacacaggagagagaaagagtggactcttcattgaaagcatgtttttctcaagcatgtgaagaaactagaatttgattattttggtgtgaaggtatataaaaatgcagcccttttgattaagccatttttaaaaacctaatgtattagtccattttcacgctgctgataaagacatacccgagactgggaagaaaaagaggtttaatggactcacagtgtcatatggctggggcggcctcacaatcatggtggaaggcaaggaggggccagtcacttcttacatgggtggctgcaggcaaagagagagagcttgtgcaggggagcttctctttataaaaccatcagatctcgtgagacttactcactatcacaacagcagcatgagaaagacctgcttccatgattcggttacctcccaccaggtccctcccacaatacatgggaattcaagatgagatttgggtggggacaaagccaaagcacatcacttaaaatatggtttttgatatctggcttattttctggctttggggtagtgtgcttgtttcttaaatcagaattttctttagaaataactatgttttatttcttcgctatcattccttgactatgcatggatctctgctgcatgaacatgttctttttttttcatggaagaaataaatatcatttctggcagaccatgacttatcctttctatctttctcgagatgatcagactccacagattgtgtaaaacttctcggaaaaaccctatttcataactcgagagtcatttttgtttgaatgtttcacggaatgttaatcctggcatatttggctgccatcatgaaggactgcagctgtgtggcgtggaaagttcaaaagaaatgacccaaaggaatgagtcataggtcagccttacaaattgggaagaaatataatcaggtaacctgtcatcacccactagaagtgttattatttattgtttattggtaaaaaataaacctgtcaccaatcattgattctgaaaaatgtgccgcttagtttattccaatgattggtacatgagctgggaggatttgtctcagggaagcactgtagttattaaataccatcaagcggacccttgatataatgaggttaaaactgtctgtgtggaggaactatactttattaaagaaggaataggaaaagaaagccaccttatcaaagtcagctttacagactaggtgacaactggttaatgaatttgctattttagttgaaaacataatttgcattactgttagacaaaatagatggggggcctttacaatcagataatgtaatctgctctagtattatggtccaaccctgttctttcatctataattttctcccacaataatgtattactattttaatactgcattctgccctgataaagtctagacttgcatcccaattccaaacgtcagcataaatgtacatatgcaccttttattgtgtgtcttcataaaccaagggcacttccaggggtacatctgttacctttaatttgcacacataggtccctgttcatgggctgctgtttataaaaaggggtttcattggcatcatttcagccttcagagtgagaaacattgaccctgcttgcttttgttacctaatattctgagctgaataaatgatgtgtacagtatcattgctccgtatgagaaaatgtaaatgactacattacattgttggaaggcagtaatacaaaagggaaatatgaagtcagccgacatttctcattcgggaaaaacaaagctgattctggtgattctgtgtgggagattgtactgggctgcaaagcgttgtcaattgaagatttttttttcccccaaaaaagaggaaactaacagtgtgctttttggcacagttgtatttttcatttcttttttttttttttttttttgaggcagggtctcactctgtcgcccaggctggagtgcagtgatgcaatctcggcccactgcaatctccacctcccgggttcaagcgattctcctgcctcagccttccgggtagatgggattacaggcgtccatcaccaggcccagctaatttttgtatttttagtggagacggggtttcaccatgttagccaggctggtctcaaactcctggcctcaggtgatctgcctgcctcggcctcccaaagtgctgggattacaggtgtgagccaccacgcctggcctgtatttttcattcctctaagatttcagtcaggtgtgcaagcccagagggaagcaggatagctgggcttcggggtcagctccaggcttcctgcagcggccaccctgtgcccccagcccgctgcgtcctcttcccagcagctcctcccctccctgcttgctcagcactcggcttccacaggccacatctatttttcttgcaaatcagaaaatgtgggtacagtgtttttaacttttgaaattttagattttgagatctcacctgacattgagagacactggctctctcaggcagtccactgcacatggagatgtcttactactcagcaaaaaggaggagggggctacagtgtacacttaaattaaaaaccaacctaacacgttgcttgcgaactttaacaaataatacattggttcctttggttcccacagggtaggaaaagaaaatgctgttgaaattattttatttgaaagaaatgccatgttgtatttattgtttcctcagtattgcaagttaaaaatctcatggatttatttaggatcatccatctaagtgcagtgcaaaaggttctgcataaatggagttctgtcattgcatcattaaaagtaaaaatgatcaaaataataaaaggcatttaaaaatgcatcattctttaatacaaagccttggtcagcattcagggaagtttatgtaaagctatataatattttgcttttaagactccataaagatgttataaactaggggccatagtttccatggatttttgatatattcaacttaattttttcattctataaatttattctaatatataaagtgattgctacttttcgttatttttacagcgacttggccccttttaagctgagggaactgaccttatgtgtcaatttccaggggaagatgatggccatcaggagtaaaaggagtgctcaataaggatgtaggtgttatactgaacaagaaggacttagcgggtgtcataattttaaagtaaatagtttttattcctgtctcccactgctccttcaagatgctctcgttatgctagtccttccctgaccttttgagggaagtctctagcaggtaccatttacctttttgtaaaaaagaaaaaaaaaagtaaacttttaattttaaataattttagatttacagaagagttgcaaagttagcacagaaggttcccatatacccttctttcagtttcctgtaacattaactttgtatataaccataataaatttatcaaaatgaacaaattaacattggtacattaccattaaccaaactacagagtttatgtagattttacccatttttccactaatgttttttgtctgttgcagtatccactccaaggcatcatgttgcatttagttgttttatgttcttagtcttctccaaaatgcataataacagtttctcatcccttccttgttttttatgaccttgatactttggaagggtactggtcagttattttgcagagattatttgattggtattgtattaaactatagatcaaattggacgaagttgacatcttcacaacattgatctaccagtccacgaacatgctgtacctctctgtttatttcggtcatctgatctttttcatcagcattttgtagtgtttagcagatagatcctgcacatatgtcaatagatttatacctaagtatttcttgactttttttttttttggtgctagtgtaaatggtagttttgggttttttaatctttcccccaaattcccattgttcattgctggtatataatacaattggtccttacatattgaccttttatctcgccatcttgctaaactcatttattatttacagaagattttttcacagattctgtgggagtttctacatagacaatcacttcatctgtgaatagagagaattgtatttcttcctctcgaatctgtattgccttgttgcactggttaggactgaatagactgtagtacaggggatgtgtcttagtccatttgtgttactgtaaaggaatacgtgaggctgggtgatttataaagaaaagaggtttatttggctcatggttctgtaggctgtgcaggaagcacggtgccagcctctgctcagcttttggagaagacctcaggctgcttccattcattgtggaaagtaaaggagagcctgtgtgcagagatcccagggcaagagcagaagcaagtagcggggaggcgccagactccctttaacaatcagccctcccaggaactaagtatagtgaatgaccaaccctttcgtgagggatctgcccccatgaccccaacgccacccaccaggccccacctccaacactggggatcaaattacagcatgagatttggaggggacaaatgtccagattttatcagagtggttagaaaaaaccacctctccttattcctgatcttaagggaaaaagccattatcttttaccattaaatctgatgttagctatatgtattttgtggatgtcccatatttggttaaggaagttcccttcaatttctcattttctgggagtttttgttatgaactttctcaaatcttttcttgcatctattgagatgatcatttgttttgttttttcttatttagtctgttaatttggtgaattgcatagattggtgaacttaccttacaatccttggatgaatcccaattggtaataatatgttattctttcgtgtacttttatatatttctggattcattttactaacatttcggtgagaatgtttatattctctattcatgagagttattcatccatagttacgtttgcttgtgatgtgtttatctagctttggtattagggtaaatgctagtctcataaaatgagaagtattcccttctcttttattttctgtaagatatcgtatagagttgttatgttcggaagatttaactagtgacactgagtctggagttttattttattttgtttttaaaggtttcactataaatacaattttgttaatacatataagactattcaggttgtttttcttcttaagtgagtttttgtagccttttttcccaaggaattagttcatgtcatctaagttgttgaatttatggtcataggattgtttttggtatctttttttttttttttacatatgtgatatcagcagtgataccatattccactcgaatattgtagttgtgccttctcttttttcttaattagcctgcctagaaatttactgcttttattgaaattttcaaagagtagcttttggtttcactgatttaatgccttttttctgaaaactttcatcatggatgctatagagttcacaatatacatttaaaaatctgaatctacctccacataatgctatgctgcttcacacggagtataaggaccttataacagtgtatttctaattcccctctcccattccttctactattattgtcatacattttacttttacatacagtatcaacacaccagatatttttactattacagctttaaccagtcagtaatcttttagagaacttaaaaataaataattttaatttaccttcctttattccatttatgatgcttttcatgtcttcgtatttatcccagtctctgacctatatcatactccttttgcctgaagaattttctttaatgtttcatgaagagtatgtctactggcagtaaattccatgagatttgtttttgtctgaaaagtctttctttctccttcacttttagaggatatttttactgggtgtagaatcctgtattgagatgtttttctttaaacatttgatgtaattccactgttttcttgtttgcatgagttctgccaagaagtctgctatatttcttatcttgctcctctgtaggcaatatgtctttttttcctctggcttccttaaatattttttatttgtcccttctttttcagtagtttgaatatcataactagatgtagagtttgtgttttgttttgttttgttttgctgcttgatgtcctctaagctttgatgatttggtgtctgtcactaattttggaaaatcctagcccattattttttcagccatttcttctgtcccttctgtttttctttctgattttataattccaattatgtatatgttaggctgtttgatattcttccacagtgcttgcatgctccatttagttttgtttgccttgttttttctctttgcatttcagattgattaattcctattgacccatcttcaagttcagtagtcttttcaagtctgctcatgagcccatcaaaagcatttttaatctaaatactgtttttctgatttctatcatttccatttaattctttttcacttaattatttttatagtttccatttttgtgtgaaattacccgtctgatcctatatgttatttactattagagcctttaacatattagctatagttgttttaaattctttgtctgataggtccaagatacatgtcatgtctgagtcttcttctgatcattgttttgtctctttgtggagtatttttccttgctttttttcatatgcctcataatagttttgttgttgttgaaagcctgttatgtcatataataggacagtagacactgaggtcaatattttgtgtggttggagatgagcatgcttttctttccactgggccattaatatgaaggtttttgttcgtttggtcagagatttggctaggtttaaagtttatcattgccatggttaccctcattctactcgaggcctaagtttctctagtggaatcatgtgttcatagcatgggataatttttcagacttgtctccgtatctgctccccatttgtcttttgagtttccctgacttgactttgagtcttctctttgcactggtcccctcagggaatctgcttcttgcagctcccctgctgtatccttcaattatgtttgcttagtgcttttgagtgtgtgcaggtcatgtgtgtgcagggattgagggcattcttttctgttctgattaagcctcaggcttaggcaggtgcctgtgaatctggggcctgaggctgtagtcctgacaagtgttcctgctccttccctacctgtcatgctgggcctagcatatattcccgcctcccttccaggggtagaactccttctccacccccgttcccctgccctatctgcagtgcgatcccacccctgccctcatgctacagtttttgttttgttttttgctctttctcctgcatagtaaggctttcattccttagggaagatgggggtgatgagtgtgtgcagagtttggtggtagctaccatttctttctgaccacagtaagattctagcagtgccttaaagctttagttttttgtccttcaccctatagattaaagcttttgttcttccaggaacataggggagatacgtctcaggagagttttggcagaggtgcctgttcttcccccacatccagcaccaagtgggggaagctgtcttaggtttctcattgagctgccctgagagcaccctttagggttcctggaggaaaatcctactctaggctcttaacccctttatgtcctggtctgtggggctttatacacgctcactagcccatacttggccttaggcagtttattcagacttctagttgaatcttcctatgggcttatagtgagttcaaggtgtctgtcccagataagcaaatggttgggtctgtttctccctggaaatgtctatctctttctggattttctaggttttgagttagttttttccctgtacccttggttctctgacagagtcaagaaaagtcattagtctgcacttcgtccagcatttttcctgtggtaagagtgagagcaatgttctttccagctctctacctctaggagctgaaagcacaagtttgctgtagccagtttctgccacttaccttttaagtcactctcagaaaaccaaatcgttctttagttcctttaatacccaagataatccccagatcacaaattaaactgtttagtcccacatagaggaaaggctctcggagcgagtttttgcctctcctatgcaatcgtgtgtcaagctggctctctgcagtgggaaaggggctgtggtaggcgtcccctctttatccccacttcagcttcttctccatctctctcagctctatgggttccacggaaccctcccagtttgtagatgtagagactcgggtaggaaagattggcaaaaactggggtgtgggcagggatctaaaggaaggagacagaaagttcagacttgaccagtactttctggaactagcagaggtggttggttataggtggtgttctcttgttagactctttgtggatacccctgaaacccctatatccttgggaatctccaccttcaggccccttaatatgtaagagtgtaccacctgcagctggtaggtcctggtgtcccctccttaactcctaccatcaggggctacacttccagcttctttgttctctcacttgcctggcagttctcttgagcaaagtctaagacactgtttctcacacaatgtgggggaaagttttgcttggtagcctcttgccataggtggtggaagtatgtcattccaatccaccgctcttccactgcaggtgctctggccagaactgctgtggtgtgagtcaggcactagtctgctgtttccctccaaattgccggggacacatccagactctcccagtgtcctcctgaagtcctcacgcttgacttgaagtgaagtagggtaggggctgaactcccagcatcctggcaactttgttcaaagtatttctcctaatttccagctttttgggcagcattttccccagtcttctttggggtagaaatgtgtgaccagctaaagtttgcaaaacaagtttttgacatccaatgctgcaggtcctgttttgaggaccttctaccatgggatgtggaaagaatcatcacatcaacttcttgggacctcaatataaactaagccaggaagaattcaatatttaaatctttttgtcctcattctcctaaaatgaacagatgcttttagaaactggttctaggaagtactttttctctgggtattatttttataattttaaaatgtaaaaacaggcattgagaactcataacatcttaagatatttagagtttaagatattgaaaattacatttcatatttcaaaacctaaaatacaatactatagtagaccttaagtggccaaatgaaagatgtttttggagaggaatggatacttactgtcttttcttttgacacagtggcacttttaatcaagataagtgaccaggcttccatgtgaagtctctagagctaaggtaggagatactagttgggctggattcaccaaatgttagcattttaacacagctctatcagacttcacacaggggccccaaaataatttttgtgtaattgaattatgtccattttaatagggattttctttttaaacgaattctactttgttcttttcttaaagcaaagacttttatgctaagataaataccttctgtccctctgcccctctcccatatttcctttgtataaatcttcattcttacattcagaggtgacgtgggcatagttgaaaggtcacagttaaaagctctagcttcagaaccagagaggcatggatacaaattctggctaggaacagaccccaatccattggaatgaataaacaactcatcagagtggccacttggtctttcagtccctaaaccctcctggcccatggcagctgagcgttgcccctgttttttccatgcattggagagtccgcctctctgagctatgtttcctccacacttgaggccaataatcatcttgcagagttgttaggaggatcaactgagggaccaactgaggttccttgcacatagtaggccctcagcagaaagtagctgctatgacattgttaaacgttcgacatctcaaagagagaacaaccgtgttccctctccaccccacagttcagtgtgcccagcttggaaactcacatctttttggggattagttaattgattggagatatgaactgtatctagtggaggcatgtctttatcttctagagaaaaatctttagatggtttatcccttttaactttggttataaaagtattaaaaaagaatacacaaaagatctgaaaaagaaacaaaatcatctgtaatcctatcacacagagttaaccactgttaacttttaaagcatatcttttcaaacttttttttctatgaaaatatggagattcgtataagacggggtatcatcctaaagtcaatgtggataacccctttcactcagtgctctatcacagacatgttttcatgtcagcaattaacaccttcatagaatgccatgatatggattttctaaatgtatttagccatcaatggaatttaggttacttgcagtgaactgcagtgaactgccttacacataagtcttttaatacatacacagctgtttccttagagtacattcgttgaagtaaatttgctggaacagagggaatgcctattttaaataatgagacatatcaccacattcactttggaaaggctgttctaagttgtacatactcccattaaagcatatgtaatgtccctgtctctgcatttaaaagctcttgaataaaacatttttatagtctttgataaatgagagaagtttctccccaaaatcaaacagtatcttttcaatttttttttcatattaaaagagaaaaactcagttgtttaaaaaataaataaaggcttttggccgggtgcggtggctcacgcctgtaatcccagccctttgggaggccgagacgggtggatcacgaggtcagcagatcaagaccatcctggctaacacggtgaaaccccatctctactaaaaatacaaaaaaattagctgggcatggtggcaggcgcctgtagtcccacttgggaggctgaggcaggagaatggcgtgaacccgggaggcggagcttgcagtgagccaagatggcaccactgcactccagcctgggtgacagagcaagactctgtctcaaaaaaataaaataaaatgaaataaataaataaataaaggctttttaaccacaaacgaagttctcttgtcatgacaactattaacactgtatttatcggaattggtgaaatcttaaatatcatctcatataatcctctctctttgtagatgagcaaagttagatcagcacttagagggttcgaagaggaagagtctcctctgtttctgttatctcttttcttctcacccaccttctcatattcaaataatcatcttttttttaattcctagaggaaatattatttttctcctaatatcagggcagccctgtgacatttaaaattcttttattggaagtctaacatgcatacacaaaagtatacaaatctcaactgaatgaactatcacaaagtaaaagcctgtgtaatcgccactcaggtcaagataaaaaaaaattttaattaacatttgctaatacagatgatcataatgaaaaatgtaaaattgctgtgacagtctcttggactacaacttctatatccgacagtcagtaatttcttgggagaaggtacccagttggtctccccacctttacgattatacttctctgggggacaatctgtaatattctgtgtgcggtaacttgcatagttttaaaacgatccacaccactgaatattcttactattcgtgaagccaaaccaagcagttgtaaggacaaaacatggcggctgcaagagtgtgtgattaggatgacaccactgtggcctaaaaccaaatgctttggtacaagtcaaaaataaatggtttggtttcaagtcacaatttggtattacccttgcagttactagatgaaggtggaggcaaacaactgggcgctttgcatctgagaagtctgcagagagtgagaagtatttgctgcagccgctgggctcagccacttgcccctgatgtcagaactccctggaggcagagaccgcagcaccctgactcctggaccccacgcccttttcaaggggccaggctgtgcttcagaaccttggcagagaaggttccaattctgtaccggctcctggcagccagccacgctcccggtactcagcctcactcagccattcgctgcgtgtccaggatggacacccagtttaatcttgttgttcagtcaatagcttttgcattatctttctttttgtggttaatgtaccatttttcttcttttcttcccctacacaaacactgccatgcctgaagtacttcccctgcttgtagagaagttatagcctgggctgtagtggaacagtgctctgattaaagtgattaaaactatatacagcatgcataattaacctttgcgcggctgtcacagcaagctgatgcatggagctgataccatatctgtctgtggcaggcggcgtatgctacatgaccattttttttttcctgcagaattttaatcacttgagataaagagccaggagagagagatcaaggctgtattaatcttctcaatggctttataatttcccttctattctgctgctggtaatcaagaaaaataatgccgccttaatcctggatgccaaggtcaatcatctctgtgccctttgatagtaaggatgtcattatgaaagggtttttaatgaacatgaacataatgctcgccgcactcctcagggagatggatgcgttctgcaacttcgggatggccaggtgggccttcattgctgacaaaaatgattttaaaacattagctctattagaaataaatcccgaacagctggttgaggttgcagaccagccgtacccagcagtgattgagaaattcaggaatgagctgcagcaggtcaacaggtgagaagggcccaagccctgattagcggttgggcaacacagcgagaaccagcacggggcgggggccttgggtagcctcagcagcaggagcccggcccgcggcgccaacaccagcgcctctctggagggctgccaagatcaaaaaagtgcagcgatgcgcagatgcgtggtgacattttaaaacaatgccctggtcttttttttttttttttttttttttttaagaacatgcagacaggtgaaaaacaaaatcctttcagctcaaacgcacctgaactaaatcccagagggctgagtgctgctgtaccactccctcccgctcttacttggttttcccaaaaacacattccccaggtcgaggtggtggagctgacccagccttcacttcactgaaagacaaaccagacgggctgagagcagttcccgggcctccagaggctgcggctcgcacagctttgccggctgtggttatgaactgtgatctgacagtggaaggcagcacttgttaggaaatctttatgtagcatgggtcacttaccctggtgaaggaaaggcgaggaaggcgtcgagttcagacttcaaatacacatgaggtacctgggattaggggaaagaaatgagtaacaagccgcccactcacccttgagaacaaaagaaaagagagaccttcatctctggtagacaggattttaataagatttgggaaaacacacaaacattcttttttttttaatctttatttttcatttattttcttcagcttttaagttccggagtgcttgtgcatgaggtgcaggtttgttacgcaggtaaacctgtgccatggtggtttgctacacgaatcaacccaccacctaggtattaagcccagcatgcattagttattcttcctgatgctctccctcccctacccatgcaacaggccccccagtgtgtgttgttcccccgccatgtgtccatgtattctcatcgttcagctcccacttagaagtgagaacatgaagtgtttggttttctgttcctgcgttggttttctgaatataacgtcttccagctccttctgcgtccctgcaaacgacaagatttcattcctttttgtggctgcatggtattccatggtgtatacgtaacacattttcttcatccattctatcattgatggacatttgggttgactccatgtctttgctattgtgactagtgctgcaatgaacatatgcatatgcgtgcatacatctttataacagcatgatttatattcatttggttatataaccagtaataggattgctgggtcaaatggtatttctgcttctagatctttcaggaattaccacactgtcttctacaatggttgaactaatttacattcccatcaacaggaaaacacacaaacattctaaagtgagccctcacaccagaatggttcctataaatggttcttctttgtatgtcttttaaaatgcattagatttactttctctcaagtggttcatggtacagcttcccttcacattgagggatgggctacggaagcttggagctctgttcccgggaggctcctgaattaccagctatattagtccattttcacgctgctgataaagacatacctgagactgggtaatttataaagaaaaagaggtttaatggactcacagttccacatagctggggaggcctcacaatcatggcggaaggcaaaaggcacgtcttacctggtggcagacaagagagaaacgagagccaagtgaaaggggaaactcctataaaatcatcagatcttgtgagacttattcacgaccacgagaacagtatgggggaaactgctccatgattcagttatctcccagccggtccctccaaaacacgtgggaattctgggagctacaattcaagatgagatttgggtggggacacagcccaaccatatcaccaggtggggggtggctgtagaggcccacttgaaatgcctttcactcctgagaatgctgcagggagggcgaccttggatgggcagagtcaaggtcaatgccgtatgagccaggagaccctgatgcgggaggcccctctttctcttcaagggctttgctcattcttctctcttttatcatctgaccccaaacactgattctttccttctagaatttgtgtttggactcagtaaatacctccatttggattctactcatttagaatgtatgatgatctgacctagtctgggatgaaatttactcttgtaccatctttgagagaagtgtacatggagccagtgtagaatgtaaatagcattgttggagcgtgtttcacctccttccatgaacaaactgtttttaaggacttagacaccgctgttgtcactatttacaaatgagccttctttttttttttaaaagccaacttggcagggtctctcctggaaaccactttgttagcaattctcttcaccagttaaaatgaaaactgaattataaaaaattctataatttagacattctctgcttcctctgagttactctattgacgcagaaaacaatttagtcatgcatacctaagagattgttctggcttttttccccttcaaatgtaatttaggtaatggaacatttgccccgtttccatagatcagttgaagtgctggctggaagggccgcccagatgtgatcctcataagaaattggaacataggaactgccacactgagttattggtgcagtttatggagctcagaggttttctactggtttctacagagcccacgggttccagggaggtgcctagaggtcttctgaggatgaagcaggagattcacggggtggccagtgggcaggaccccacacacacaggcttcgaccagagaagcctgctttcctctgttttctgcattggggttctcctaggatttgttagggggaaaagaggtttcttaaaagcttaaggccttgtatatagccctttgctctgtctcaatagaatttataaagacaagattgatctccttgataagtcttaagcgaggaacgtgcctgaacggctaagtgcttgttgcagacattatgagcctgtctgccgcacatgaatccagctgtgtgtgtgcacatgcaggtgtgtgtatgtgtgcggcccttcattatttgaggcccctaaaaaatcacgtcgttgccaaaatgagttccagaaattcatccagtaaccagggcacatggggaccaacagaagactttgagcttaaatagtcctggaccccagatcgtgcaggcctttgacctctgttcgaagaaatcaaaactgtgccatgaagacagaaccagaaacctagagtcgtcctctggacctcgctccctcgctccctccctccctccctccctcccattgtctagcagagggatcatcactcttcctccacggtggttcttgaatacagtccttcctccattcctcttgccctagttctagtctcatcattttggcctaaatgacttggtatcttaatttttctgtctccagcgttttctccttcactcaaacgtccacatggcctcaatattcctacttttaaaacatcaatacgatgaagtcaccaaacttaaaaataatctttagttgtttctcattgccagaggatgaaagtccaaagtccaacccccttaggaagatatttaaaactttacacaatgtcattctaagtgattggttttttgtttgtttgtttgttttttgtttgtttgtttttttgtttttttttttttttgagacagggtctcgctgtgtcacgcaggctggagggcagttgcagaatcatagctcgctgcagcctcgacctcctgggctcaagcgatcctcccacctcagcctccgaaagcatggggattacaggcgtgagccactgcacccggccgcctttctttccttgtagctttttgatggctgtgcattatttcatgtcccactagactgaggctcagtgagggcctcttgcgtttgaaagccttgtgtctggcgcataaaaggagttccatgggtttgaactcagtgcgcgggaagttgtgctttgttgtttgatactgttggtttgtgagtatcactgcacgccaggcctctaacgtttgcctctttctacctcctcacaactactttactcagtgagagcagttagcgccgtttctcagatgaggacactgagtctcagggagattaggcacctgggttaactttattattatttaccatcctttgcatcccccatctttgagcacatattgtgtgccaggcttgttctaggtgctgggaacacactcactggaggctgagggcaagtgcacgggccagtgtggggaccggcccctccagctccagctcccaggaactacagctatgggcagagcccatgaagcaagcgtggttagatctctataaatagttacatctctggtgtggctccttccaacttgtgaaggacaaggtaactcctcagcgtgagtcattactgaattacagattagctgatggggccttctctgctacagagtgggcctgggctttaaggcctgggactaggggaggtggaagcttatccctttctcgccataagcgctgtcactccagagcggtgctgcgcaaattggaaaggagataggaaggtgatgtcctttcacccttgacctcctagtgtgtctcccccgacccccaccccgccccatctctgccaatagcccctggggactatggctaaggggtcaggtgcacctgagcctaaacctgcccatccctaaggctgttctggtaattcgggaatgagggatgtccacaacgcgagggctgtgggtccgagaggccttccctgctggccatggcagtccctagtggctggttttgagcgagtgctataagtgcactggcagtgactctaggccggctgctttgggaataacgtctgtaaactgactgacgcccggtggcaacagagttccttgaatttggtaacttgggggtgggctgcgtgggctgtgggggctgaagccacctatgacacacactcatcacattccacagagaatgcagtgcagccctctctgatgatttatttgctctgttttctgtttattgtacgttattatccctgtgctttcggtacacgtgtcacttactaagaacccaccatggctttgtcctatcaagtcggccccgtctagcacctcaggcctgtaccacctggctgcggctcccagccctgccttcctccctcttgatggtgtgggagaatttcgtgtgtctctgttttctttcctaagttgataaacgctgtggtatcaattatcatatctttcaataaataggttagatgttgcttaattgtttagttaattcctggcctactttatttcctgtgatgccgccatgccaagctgcattagttgtacagttccattgaagcctttcccttctcttgtttcctcccaaagttcaaaataagtaacaatggtgatgacaaatgctaacactcatttagcactttctggagatgccggagaaaagtatgcattctgctgttgttttgttgcgaattctcccacttactcctaagttgagttctgagtttggatggtctcagaggcatcccgtgaaaaaaggatttcagtgcaaggggtttatcgaggaggtgatcctaggaggcggtgccgtgccacagggaagggaaggcagcagatcggaggttatcaggcatggtggccccgcagagacctgcagctcagcccctcaggaacaaagggaggtggtgcaaaacacggactgtacagttatcctacgtcagggatgaaggatggatctgggccttctacagcaactcccagcagtcacctttgttcagtgctgcacatcggggattctaattctctggaacatctggtcattgtggaagaaagcagagtggactccagccaccagagagagaaagctgttaggcaaagagatagagatgccggacataggaagtcggccagcatgcgctgtacggctgtagaggacacaggcagcagcagcacggctgcaccagaccatcggggtatttttactttacagataatgaagctgagtcttagaggactaagtagcttgcctccagtaacacttggaagtcttttgtgttctttactctctgaaaaattctgacaatacaaatatttaactttcagttgagttcaccagttgttcagtgagcttggtttctgcctatatttgggttgggtatattttccacttgaccctgcctcaaaagttggcttttggccagacatggtggtaacacctgtagtcccagcattttgggaggctggggcaagaggattacttaaagctacaaattcgacaccagcctgagaaacaaagcaaggacctgtctctacaaaaaatattaaaaattagctaagcatggtggtatgatcctgtagtctcaactacttgggaggctaaggcaagaggatcacttgagcccaggagtttgaggttgcagtgagctgtaatcacactactgcacaccaacctgggcaagagaatgagatctcaatttaaaaaacttggctcttgaagtgccaagcctccttgcatccatgaaacattatgttgcagcctactctgaagagaaaccaatgaggctacgttaatattttttttgaatgatatatttttaattcagacttggagtaattgatgggctaggttatgccgctgttgcaaacaactcggtaatctcagtggtttgacacagcctgggttcatttctcacctatacagcgtccacagcaggtccatgtgggtactcaggggtccaggctgctttgatcttgtggctcccctatctgaagctcagcagtagccctggcaaatcacaaggatgactggagacttgtgcttggacctttcactaattcactccagaaatgataatgacatttctatttccatgtcattagccaaaaaaaatggccccaactaattacatgaaagctgacaagtacaatcttccttgtgcctcgaacaggcaggggaggaaccgtggagtattagtgaacatggaaagcatgtttcccagtagagaagtaataataattgagcaatcatgatcaaggcccgcctagggcatttcctggggatttctgaaaggctggaagaattttgccttgggctgtaaatgtcaattgctcattaattcctcagaaatgcccacagccaaggttgctattgctaataaaattcatttgtttggttatttaacaaaacaaaaaaagcatgttgtcattttcccctggcctgatgattcctgaagcagatgattattctctatgttctacatcatatgagtttgtatcatctttttcttttctacctctccaagtgggtggggagtaaatctcattggcctgaaatatcatcacgggcagtactcagccattgttctcacagctgttttgaaatataaataacaaaaaaatgcattttaacgttaatttcaatatttctttccgccttagcaactgacgtaagatttgctggtattgggttttctgcaaatttttattcaaatgtgttgtcttgtatttcttttgtctgtctgactgttttacagaaaaagtgaccactatgtagttcttgtcaccttaacaataaaggtgcttttcaagtggtctatatttcttttaaatatgtttcagtcaaaaggagaccaaaagagttagtaaagaattgggtcagccttactgaaacaaatggttgaagtttgacttctctcatcagtgaatgatagatgccgcaccttctgcctggctggcacagactccatttgatgtaggaggaactcatacccttgtagcttttcccacgttgttgtgaaaactgcggaaataattccttgttccatgtgagaacgagtcatcacttaacttgatgctgttttcatcatattgtcccatcccacagtctggcccacagcctggcccacagcatcggggtggaaccagaaatggctcctgcggagagcaaagcaggacatgaaccgtaccccgcctctgcaaggcttatgctgttattagtcctgatgtacagagtggattcacagaggcccttgaggaccaaaagagaaaatatattcagtaaatcaatggtgatgcgttaatagactgctgctgtatttgttgttcacagaatgtaattccttgataatggcattttctacagtatatcatcacagaacaatagcaatatcaccacaacaggagtgactttgataaattatacaagaataggatcttataatttagtacagatctaatttaggttaaaagtattggtggagaaggagatttcatttttaacattgttcagaggtacaaaaaatcctgggagaaaaaattcagacatattgtgagaagccaatgcacatattaagttattggtgcagatttcgcaaggttttcacatcttttgactcattctcgtattctatatgttatgctatatgttattttaatgtttcattttactagaagttaatctatgtgtctaaaaattgcaagagtgttaaaaaggaactatggctctttattattttaaaagtggagatctaggaatagcataattttgttgctattgagtttttaactagatgtgttgatattccttgataatgtttcaaggatcctgacataatcaaccgtggctcttgcttcctctgggaccttgaagctcaaaaacccagtagcagctcttagcactcttaaggctgataaaaattgagactgaaagtgatatctaatcaatgcctctgagattcaatcaaatattaagatccttgaggccatcacactatttaattggattcctaatacttctttatactcagatagactcctgtgtccaaaggcactcacattggtgaagctggcagcacatcgtgagaggaggccattctccctgtcctggcccctggcatcccagagtcaggcctacagttgggctctcccaggacagtgaatgaagtgcaggtggcagaaagacaaaaagagggtcgagttccttcatggcagctgtagctgcattggaatctaccgtggtggtgtccagaggtggcatgccctacagtggtaccagtggcattctggctagatgattctttttttttttagggatggtgtcttgctctgccacccaggctggagtgcagaggagcgatctcagctcactgcaagctctgcctcccggcttcatgccattctcctgcctcagcctcccaagtagctgggactacaggtgcccgccacctcgcctggctaatttttttgtatttttagtagagacagggtttcatcgtgttagccaggatggtctcaatctcctgacctcgtgatccaccctcctcgacctcccaaagtgctgggattacaggcatgagccatcgtgcctggcctatatgattcttactagaaggcggaggttgtgtttcagaggtaactagtctcctgctggtctgtcttccaaggccagtcaacctcttccagcttttgtgaactcttgagaaccttccaggaaactccccgctcctcctcctcacttttgtgtaagttaacctgattggtttctatcatttgcaaccaagaacctctgactggttcagtggtcagtattggctcaacatttcctaaatgctcaaatcagacagagccttgggagaccgtctgtccctcattttacagatggatttcagacatggccctagctcagagtcctgcagacagttggtagctgagcagggactagaactctgtcctcttgattccagatacagtgctcttttcacctgtggcctttctagtctagagaattactctgcagacctgcactgcatggtaggcgctagccacatggagttgttgagcacttacaatgtggtacaatccaaattgatacgtgctatgtgtgaaatacacagcagattgcgaagactttgtgccgggaaaaatgtcaatgatctcacatttatgtttttatgttgattgcatgttgaaattgtagatgtgttgggtgagataaacaacatcattaagcttgttttttacctttttctttgtactttattcaacatggctgtcagaaaaattaaagttgcatgtgtaacatggactatgcacacgttgaaccaagctgctgtatgcaattataagaaaagataacacttgagtctctatgggtaacattgggcctgtggttattgtgctgggatattgtatttgtttttgctgtggttaaaaaaaaaaaaaagtagcgggtgtggtagctcgtgcctgtaatcccagcactttgggaggctgaggcagtcggatcacctgaggtcaggagttcgagacgagcctgggcaacatggtgaaaccctgtctctactaaaaatacaaaaattagccaggtgttgtggtgggtgcctgtagtcccacttacttgggaggttgaggcaggagaatcgcttgaacccaggagggggaggttgcagtgagccgaaagcactccagcctgggtgatatagctagaatccatctcaaaacaccatttatttttcactatgggtctaccagttggctgtggcttcactgggcccaaccaggccagcctaaccttagctgggctctatgtgttttacattttgggacccaggctctggtggagccatcactgtctagagcacatccttcaagcaccggaatagaactggaaacacagtagagactcaaagacaggataagcccagtggtacttccactgggaaagaggatgggggaggccccacagtccacagcagtcctagtgtcctgctgggcaaatatttcaaggacccgtaggctgggagtagggggtgtcgattgggcctcagtcgtgctcccggggaggactttccaggccgtggttttcgtggctctgaatctgccctctgccaggtgcactcttctgtcatcctccatggctacctctgaggaaggtgctggaagacatgctctccttcatggctgagcagatttcttaacctgcttcctgcccataggaaggatgaatgccgaggatcgttttagatctcaaatgccacggtctatgttaatccagccgaaagtgtagttatcgatttgtcccttttgaagctgtcctgtttgtttttaatctctttgattccggtcaaccccgtgtgcctacagtcatttttcgtgcatgtcctcctttctctaaactcaattccaagtacactgagcacatcatgcttccaacaggccaaattctgggtctctttctctaggccattttgtgcagttgaaagatttcattggggaccttgataatccaactaaaggtttcggcgcaagagccaatgattgcatctttgatttggtctttacccgtaggctgtgctttcacggccaaccttaatttggtgagaaattgcttcactttaaaatcctgaaaatgttgtattttctctcttccctttcaattgtatttgcaaagcagtgagttttttgggaggaggcaaggtgcatttttttttccttatagcacggtgtcaaaggcattctataacaccagttcacacaggcaagattctgttttgaaaacaagtttagttaggccaattttctaagttatcataggttatttcttttttctttttctttttttgccgggtgttttaacactgcatatcttgggttgccatttttccaacttcctttaacaactttccagcttgccatcacctaaacccaaaaccaatgacccatatttcaggtttttgtaatggcagccctacttctgtgtaccaatttctgtattagcttttgctgcagtaactagcaattctcaaatctccatggcttccaacaacaaacacttatttttcacttaagaatcctgcgagtcagctgcagctctgccgagcttggctgtgttctccacgtctcctcatgccaggctgaggctgaatgagcagctgccatctgggccctgctcttctcatgctggagggcaggagctccggaggggaagcgggaacccccaggatctcataaagcctctgctgggacctggcagccgtcccctcctcccacaagtcatatggcaagcccaaggttaatggggtgagcctgtacccttcacctcctggcaagtcacgatgaggagagggcagagacaaatcattttgaacaagtgatacagtctctcacaggcatagattccaaaaagaaacccaggagagagtcaccatgcctcaaatcaagaacagccatattgcatttctatcaaggcagaagcacaggtgtgacagtgtgacaatgaaccctgagaccggaggccctccagtccaggtggacatccagctatgcagccagctcagtgcagccgaaagaacctgggaggcagtccggaaagctgagttcctcttacccgtatccctgcagcaagccactttccctctgtggatctcaagttcctcttcaatattaaccaagagttaagcagaatcgtgggttgctttcgaggatgccgttctgatctctgccagcgcacttcacatggcagggaacaggctgccttcccaggaggccgagctgcagtagaaggagcatgagtttaggaatcaggccaatttgagcgggaagcccaggcagccgtttaccaggtgtgggtccatcatataccctctgactctgtttcctcatctgtgaagtgaacatcacagcatctaactctcagggctgtgggtaggataattattttatacagtgccttttgctaggaaattttttgttgtgttgagtcaaaatctgatcccttaaccagtgaactccggccccggttctgcctctgcctggggcagcaaaacagtgattaggaatatgggcacgggggtcatcccacctgggtctgaatcgcactgtctgctcctggtcaggatggccggggggaggatccttaatgcccccgcggttggcttgctatgcttatctgtaaatgagctactgataatatcaacttcatagttttgttgtggggataaatgagccggtgcatgcaaactcaagtagctgttattatttcagttggcagctcctcaggtacctgagcctgctttccataccttctgggtcatcccgtatttcttcagggtaagcaacctcacatttctccagcattctgtagatgtcaagctttctgcaatcctcccccgtctagctgtcctcttgagaatctccttcaggagctctggttaagagataaagaaacagtgagggcattcgagttcattatcccagccacgatggcattctagatgtctccacagacattcaggatctgcccagggtcccacatctgtctcttctccacatcttaccctgccttctccaggtgatggtgatttcgtgatcccagtcacctgcccccaccctcaccttatctgaccctggctcctgggccacccacttgccacttggaatatttattgtctaactgattttccagtattaaggattttacaggtttacactggaattagaagttcatctgaactgcctgtgatgtccctgctggtttcccaatggccaggcactgcagagatgtataagatacgagaatacagtcacctaaagacatgggaagttttgtaagcaatgtctcccgagattccccattctaaatatggcaaggagtgttttaagtacttcatgcttgaagcttttcatgcatttccatcgttgcagttggaccagttttaaaatatatatatcataaataatcttcagaacattttaatgtactaccgatggtattaaaagtcaaagctttcacaaaatttaatttacttctccctgtaacttaagaacagttttaaaatgtgcatggctcctgctaaatttaacagcttccccttttgccttctcgactggaggctgcaacaacctgagccaggaggtctggcgactacaatgtttgagtgaagctgtgagatccatgcctgtactggaagctcctgacagcctctgcagggccttggtgccaggctccgggggtggtgggggagtgggctttccttcttagaaagcctctaggctttgcaggttcaggaagaagctcaccagctgggtccagccactgaaaggaaccctgagcctcagtttgcagcccagagatgctccggggtctcgcccagtgcatattcctggagagctacaacatcagggcatcagatccacagaagatacatgtgcttcactatacaccaggtgtgtattgaaactaaagcagagtaatactattttttcttttttttttttttttttgagacggagtctcactctgtccccccggttggagtgcagtgatgcaatctcggttcactgcaacctctgcctcccaagtttaagcgatttgtacttcagcctcccgagtagctggtggcacgtgccaccatgcctggctaattttttgtgtcttttagtagagaaggggtttcaccatgtcggccaactcctgacctcaggtgatctgcctgctttggcctcctgaagtgctgggattacaggtgtgagccactgagccctgccaagactctcatttcctaactcttgattaccagcgtgtctctaatgtacattttactgattcattcctctaaaaatattgttgcttttactcaatatggtaaaagtttctattatagggtaagaagaatagcacaaaatattcaccaggcatggaggatatcattgcagttcaagaaagaaatcataagtagtaattaaggggcttggtacccatagagtcatctcatcatcactgtaataaatcattcttatatttatttattggagcctgaggatgttaaacccttacttttgtatgaccattcatagcttattggtgctttcatctttatagaaacacattagagtctggctgcctcagggcccattccctagtcacttccagccagacatccatgtatcaaagctctagccaatcaacatgtagtggacgtctgctaagtagggcttccaaggatgttttctgtttagaataaaaagggggaaatgtggctagccacatttgaccactatcccttcttctggaacatggatgtaaagctggagacagtgtagccatctcgtgaccacgaagcagtgatgaggaagacaagaagcaactcacggaaggacccatgccccctttctctttccactccgctgtcctgaggcttcttcttcttcctcttcttttcaagttgcgtaaagtggatacttagatccctgaagtcagacctttcttcttttctagtgtaagtgcttgatgccatcagtatccccaggcactgctttaggctcatctccccatttttatgttgggtcttcattttctttcatgacaaaatatcttctaattccctttgcattttctcctttcacccatggattatttataagtgtgttgttaagttctaactctttggcgattttccagataactttctgttactgatttctgatttaattctgcggtggccagaaaacatactctgcatgatttcaatccttttaaatttattgagatttgttttatggcccagaatatcttggcatatgttctgtgtgcacttaaaaagaatttgtattttgctgttgttgggtggagtgttctgtaaatatcaattaggtcaagctggttgatagtcccgttcaagtcttctgtttactgattttctaagttttaaagacattttaaaaaatgaaaaacgaaatgtttatatatttactcacatattgaccatttctgctgttctttatcccctgtgtacattcagcttttggtttggcatcttccttctccctgaaggcatgtccttaatacttcttgaagtgctggcctgatggtttaaattccacccagtgccctatgcatgagcgctggtaggagcacaccctcttcctggccttgtgtgggctgtcaggattatgttgcctcctcctgttatttcctggccttggtagtttccttacctgtatgcacagatcaacactcagcaaaagaccctgaagctctgtctgccacagctgcctcttctgtggcatttttctccactagctttagcctcctgggcctccgcagactctaaactctggcttgttaactcagcaagcccactgggatctgtctggcttccctcagcctggattgggaactctttcaaggcagcgagctggacactcttttgttttccttcacccaggaatcactgtcccgtgctgccggtggtccagtgtcagaaatcgctgcttcacatattttgtctggttttcaagctgtttaaggtgggggaataaatctgattcctgttactgtatcatggctgaaagcaaaagtcctcttcacctacttaaaaaaacttaattgtagcaaaatatacatgtattagtttgttttcacactgctataaataactacctgagactgggtaatttataaagagaagaggtagaattgactcacagtcctgcatggctggggaggcctcaggaaagttacaatcatggcagaagggtgaaggggaagaaggcatgtcttacatggcatcaggagagagagagcagaggggaagaactgcacacttaccaaacaaccagatttcgtgagaattctatcatgaaagcagcaagagggaaattcaccccttaattcaatcacctcccactaggccactgccacaacacatggggattacaacttgagatgacatttgggaggggaccagagccaaaccatatcaatacataacataaaatttagcatcttctccattttaagtctcccgttcagtaagaagtattatgcacattaacatttctgcacactcatcaccatcatgcatttccagaacatttccagcttgctcaactggaagctctttccccatcaaacaatgattctcattctccccttccccagcccctggcacccaccattgtacttcctgtctccttgaattctactactctagaggcctcatataagtggagacacacagtgtctgcccttttgtgtgtgacttatctcagcataatgtctttgaggctatccatattgtagtatgtgttggaatttccttcttttttaaggtaaaataatatgaccttatatgtatagaccatattatgtctttcctttcatgtgacggacacttgggctgctcccccttgtggctgttatgaacagtgctcccatttgccacgttcttcttaatgttcaacaactttgttaaaattatttaaatgcaatgatagtcatctcaccatgtagttcaacttgtttttacagctgtgtgtgtgtgtgtgtgtgttataatgggaagaagatgaaataaatggttatagttaatttgggaactttgatcaaatcccctttctttccatattcctttccttttttcttttcttaaatttcccttttcttatcttttctctcatcttttactcttctctttgctctttcttttctctcactcttttcttctcctttccttttctgctcttattccatttcttgccctcctttccttccatgtgtgcacagtacactgacccaggaagccgccgtgtgcacacacaccccaatcaacatgactgaggtgctacggtattagcatgaagcaactcatattccaggggcagagagaagatgtgaacatccatgaatgtaacctgagttgaagtggcctgaatagaagaacagaagtgcagatacggtgctttaattactcagtgacagaggttatttttggttagggagaatctggaaagtcttcattgtagggccgacagttgacctgaaacctgagagtcgggcacagttggggtttccaacaggtgcaaagattttctaggttacagaaccactagagcaaaaagcgcagacatgggacaagcctgctgtccggtacaatgtcacatcatgatgccattcagacctcttttcccaaagattctaactagcttttttaaactttacagtgatatacagaaaatgataaatacaagtcatcattaaaatggaacaatgaaaattactcacttttcatgcactttgcccttttctgattggttttagactcggtacattgcaaatatttttccaattttatcatttgtcttttgtgttttacatcctgttgtccttaaggaaataactgcaacaaaagagcagcatctcaggaattctcactgatgaaaatgagtcatccgaattaacaaaaagtttgaattactaacttattaatagaattttggttttattatgtcacgccccttgtgtcatccttgattgccaaactaagtcttagtaattagagctcgttgggaacgtgttttaataaatagatggtgattgtttcatttttaagtgccaagaagttcattctttactaggctaaattcatctgtaacatcttatgttgttaatcagtttaaggaaatattttacctttaaataaatgtatttttagcctaatttgtaaacaaattatcataaattctaagttaatggtttcccaattctatagtaaggtgaaacagtccatatctacctcattttattatcgtatcagctcaattttaggcctccttttggtttccatttaagtcatgagaaatttactaaaatatcatatttcctgtgatcctgtcagtcttactggtgactttaagtgaaacaatgtgtgagaattgtctttggaaagcaaagttgttcaccctccctgatctgctgttgaggaacctccatgctcttcttaatatatgagtatgtatcaccctcagtctccctacagaaatattgcgctttaacacttccactttttccatgacacatctgtccttgcccctccttggcttggagttctttcatatctccccatcatctacaggctaaagtctgtttgagagcagaactttgtagccaaaaggcccatttaaatcctatgtctaccacgtgagatgcaacttacaggataatcactcattttctctcggcatcagcttccttgtctaggaagggggagcagtgtggctgccctacagcattggtgggaagactaatgagaaaaggctcagaaagtcctcagctgtccccgggtgcagagtgggccctcccgaggtggcacactgccttgacctcctgagcagtggacaggttcctcctccctcccaggcctgctcagccaggtccaagctgcaccagctccacaggcacgcctgccacgcagccccgtggaagcacctcctctgtcggccatcagcatgtgggccatgctgcatctctctccccagatgtccttgcccaccctcagatatctccacgcatccctgaaggctgacactcctctatagggggcgttaccaggcccctgccaccccaggcacactgagaagtgctttgtccctgcttcccggacctggcacacagctctgctgcaggcattgtgtggaaatcacagttcttacctcacacattcccttgaccgcatgcattttaaagcatttgaatgaatttttaaaaattctaactgtgaaatatttcagccatgtggaaagctgtaatcggataccagtgtatgacactaacatttaacaaatacgaacattttaaagagaaagcagttttacaaaaaaacctaaccctcctcccagtttcctctttgctgaagaaaccatgaacctgaagttggtgctactccttctaatctgtgtctttatattttattacatattttcatccccataattctctggaatagcatttgtatatttttaaaatttacataaatattttcacctttaaagtggttcccctcaaatatttaacacgcgtaattgaacagagtctaaaatttaccaacatgttctgcctgaacaggcttcaatttctcttgcatcgttcatgttttgtggtccgctgtttaggttttatctggtttttcatccccaggttggttataataacaacacaacgtcattttttcctgtttggtgctgatttagcctttccagtgtgtttaactcatcattgcttctctcgtcctgcccatccttcttggcttcatatccttatagaatttctccttcagaaatcatttcccactggaaggctggaaatagctttatttaccctccctctctttttctcccacctttattttggaagatttcaacctgcagaaatgtaaggtgaattaactgaatacctgacacccttcacctagattcacccaccatgagcatttggccgcttcgagtcccctctctccccctctccatttccctcccctctttccctctttgcatgctctgtcacacactcgttttagactgacacatttgcagatttgttgcagacattcctccctaatactccagcgatcttcaacataaccaccataaaatcattgctcttgaaaatttcgcattgatttatgtgtagttctgttatctaatatatcattcaaattcaaatgtgcctaattgtagcaaaaaaaaagacctttatggcttttctttttcaattctagcgtccaattaaggattatttactgtctttagtaaaaacatctccttacccataatctaatcgttccctggcctttcattttttctcaacattgacatctttgaaaactccagaccagttgtttggcagaatgtccttcagtcttgaatttggctgactgtgtattctttgtcagattcaagttaactgtctttttttttcttttttctttttttttcccgacagagtcttgctctgtcaccaagctggagtgtggtggcacgatctcagctcactgcaacctccgcctcccgggttcaagcgattctcctgcctcagcctcccgagtagctgggactacaggcatgtgccaccacgcccggttaattttttgtttttttaatagagacggggtttcaccgtgctagccaggatggtctcgatctcttgaccttgtaatctgcctgccttggcctcccaaagtgctgggattacaggtatgagccaagttaactatcgtaatgaccccatgtccttgtcagtgcaccacatcagaggccacctgatgtcaacttgtcccattattgattattttgagtgtgattattaagctaaatggggaccaacaggtttgtccaaagggaaaggtgcatttttcctttgtgagttatcaataatctgtgtggtaataccttgaaactatgggactattctgtttcttaacactctttactcactcacgggtgactcttgcctcagtcaactattaccacgatgtttgtgtcctaacttctaccatcctttgtgtgtttattaggttagtcttcttctgtaaggaactccttttccttcttcacatttccattcctttttttaggaagggactcttgttctttgtgttaattgaatatgttataatatcccgttactcatttaggtgttaacattgtttcagatttggctgctgggcatggtttcagagtatctcctctatcttttccggatgttctcctctgtctttgagtgtgtctcactttctagcacaacaagctgctccaggctcacctgtatttttcctgccccagccctggaatcagccattgctccaagaagctttggtgcctttgagtgcaatatgatatttacgaaccaagatctggctgctaagtgtgcttattacttccttggtgttcttactcccagactcttcagtggctagaaatgtgcgcgtgtgcatgtgtgtgtgtgtattttaaatcatgagtttacgctgacatctctaattccagttcatcatcacagggttcttcctctcctcccattccatgtttgtgtctcccttctcccacaataagaaccctgattccccatcacattaatgtatttacccacttattcaatcctacaattcacacaaaattgtttttggaattgctataccgatactactgctcactacaaattcagtaagagagatttaatatttccttctggttcttcttgtgcctggaagatgtctcattaagggttacagtcagatattgagttctaaactttcttgccttaatttttttttcctcttccatttgttatattacctatttgatgtatagctaggtttactggtttctttgtaggaaaactttcctgtgtcttaattgaataatatatttgtggatatataaactgttagtatagttcaaaagtctaaattacatgaaaagatgtggtcagagaagcctcatcgccttccctgtccatgccttgtactccattctcaacaatgcttcataaagagctgttttcaaagttcctggtatatcctttctatgttttattgtttgctagtttttgtttgttttgctgaaataagaatatagcacagaatgacagaaaaaattgcaaaccatatatctggtaaaggtcattgtccataacacataaagaatttttaccactcaacaataaaaagacaaatggcctaattttaaaatggacaaaggattttaataggcatttttccaaagaagataaaaaaaacgggcaataaacacctgagaaaatgcttaacataattagccatcagggaaatgcaaatcaataccacagtggggtacctctttactctcactaggatgacaggttttttagtttgtttgtttgtggttttgttttttgttttgtttttttttttttgagacagacgagactccgtcgctcaggctagagtgcagtggtgtaatctcggctcactgcaagctccacctcccgggttcactccattctcctgcctcagcctcccgagtagctgggactacaggtgcccgccaccatggccggctaattttttgtgtttttagtagagacgaggtttcaccgtgttagccaggatggtctcgatcatctgctgaccttgtgatccgcccacctcggcctcccaaagtgcttggattacaggcacgagccaccgcgcccggccgacagtttttttcttaatggaaaattggaagtgttggcaagaagtagatacattttaacccttatacattgtttataggattgtaaaagggtacagctgctgtggaaaagagtttggcatttcctcaaaaagttaaatacagagttactatatgacctagcaataccactcctaggtatgtatgcaagagaactgaaagcatatgttcactcaaaaaatggtacacacatgttttttagcactcatgaaatactgctatgtggtatgtgatggtttggatgtttgtcccttccaagcctcaagttgaaatttgatctcccgtgttggaggtggggcctcatgggaggtgtttgggtcacggaagtgggtccctcatgaacagattagtactctcccttgggagtgagttcttgccctattggttcctgagagagctggttgttaaaaaagagccttgcacctcctagactctgtcttgctttctctctggccatgtaatcttcgcacacgagacaccccttccccttccaccatgagtggaagcagcctgaggccctcaccacatgcagacgtccaatcttgaacttcccagccatcagaattgtgagccaactacacctcttttctttataaaccacccagtctcaggtattctgttaaagtaacacaaaacagactgagatgtggtacaagatagatgaaccttgaaaacattatgctgagtgaaagaagctagacacaaagacccacatactgcatgaatcagtttatatgaaatgtgcaaaatacacaaatctatagagacagaaagtagagtagtagttcccaggggctgtggggagaggggcaatggaaagtgagtgctgaagagtataggatttccttttggagtggaaaaaatactctggaactaggaagtgctacacaacctggtgaatataatataatataaatattctgtaatgaaactagcctggtgcagtgactcacacctgtaatgcactttgggaggctgaggtgggaggatcgcttgagtccaggagttcaagagcagcctgagcagcagggcaagaccctgtctctacaagaaatgtataaaaattagcagacatggtggtgcacacttgtagtcacagctactcagaaggctgatgtggaggatggcttcagcccggaagatcaaggctgcagtgggctacgataacaccacttcactccagcctgagagacagagtgaaaccatgtatctaaaaaaaattaataataggccgggcacggtggctcacgcctgtaatcccagcactttgggaggcctaggaggggggatcacaaggtcaggagatcgagaccatcctggagaacacaatagaatcccgtctctactgaaaatacaaaagattagccgggtgtggtggtgggcgcctgtagtcccagctactcgggagactgaggcaggagaatggcgtgaacccgggaggtggagctttcagtgagtggagatcgcgccactgcactccagcctgggtgacagagcgagactccgtctcaaaaaaaaaaaaaaaaataataataataaaacctacttatctgtgtattttacagtcgtaacttttatgatatatgaattatatctcaataaaaatacaatcatttttaaagtataatcagcaccttttttttttccaattcatatcctggaaatcagcccacatcagttcatagataacttcaccattttttttattttttaaatagctactacgtgtttgttataccacggtttattctgtcagtctcctatatggacatttaaacgactttcactatttttctattataagtaatgccgcaatgaatatttgtgcattatttttgtatcactggaggtaatgttactctcattcttgaatgatagtctggatgtatataaaactctaggttgatatttcactttctttcaatcctttgacacttttgttacattttattttaggctttttatttttctggtaagaaatctgctttcagtataattattctattgtggataatctttccctatggtttttagggttgttttttccttatctttgctgtctacagtttcactaggtagttattttctcctgtttaagaatcattatgtttcttgtttctttagaatcatgtcctttatcaattccaaagttttttttttagaggaacgttcttgctctgttgtccaggctggagtgcagtggcacaatcactcactgtaaccccgaactcctgggttcaagcaatcttctagactcagcctcctgagtagcaaggaccacaaacacatgccactatccctggctaattaaaaaaaaaaatgtggagataagtgtcttgctatgttgcccaggctggtcttgaactcttggcctcaagcgatcctcccacctcagcctcccaaagtgctgagattgcaggtatgagccactgtacctggcctcagtttcaaaattcttagccttattttttctgaatatttctttttttcacttgttttggtctccttctagaactccgatttaagcatatttgcatcttctcattttgccttattttctcttcccattcatcgtttctgtctctctttgctacattctggaaactttcctcaatctctttttcattcagttattttctctttagctttgtcttacctgatgtttgtcctcacctttgagtttttaattccaatgactatatttttcatttgtgtttccatttgctactcttcaaatccaccttttcatcgtgttctattattttgttagaactttaattattttatgtttaatcatttttaacttattttgtagtgtctcccaaattattgtagtaagttcaggggtggaaattctgtttcagaacatactaatctttacaatggtggctgtatgcgtatgtgtgtgtgtgtgtgtgagagagagagagagacagagagcgcgcgagtgcaggagctcatcttcattaattgttacattcatggaacgctcatgctccctgaactgtgccttaccatcaaatggtttcacctctgcttgtgctattgtcctgctggtttcaatggtttagagctggtttaaattaatttttcagattaaggagccctccaagacacaggtagcatttcagtgtcttttttttttttttttttttttttttttgagacagagtcttgttctgtcgcccaggctggagtgcagtggcaagatctcggctcactgcaacctctgcctcccaggttcaagcaattatcctgcctcagcctcctgagtagctgggactacaggtgcacgccaccatgtccagctaagtttttgtattttttagtagagacggggtttcaccatgttgcctaggctggtcgcaaactcctgagctcaggcaatccgcccacctcggcctcccgaagtgctgggatggcaggcatgagccaccgtaccctgcctctgtgtcttttttgatctcctttctagcgcatgctgtcttcttttctccatcaagcttaccttttcatttaaaatttccttcttatatttcacctagaatcttacgtccttgtagcaggaatagggtctgagccagtgtattctaatatgttgctaaaatcagatatatttaaatatattctctctttttttattatgaagatttgtctctatctgtaaaacttaaaacttgccattttagccatgcaacttagtagcattaattacatgcacattgttgtgtaaacatcctgcatatctatttcaaaaatgttttatcacccaaacagaagctctgtacctattaactcctctattcccacctcccctttcgccactggtagctgcttttctgcctagtgtctctgtgaatttgcatattcgaaatatttcacatattcgtccttttgtgtctggcttattttacttaccgtaatgtttgtaaggattgtctacattgtagcatgtgtcaaaaactcattgctttttgtggctgaacactatttcattatctgacataccacactctatgtatccacttgcccgttcatgtacatataggttgtttctgcctattggctcttgtgaataatgctgcagtgaacattcgtgtacaagtatctgttcgagtctctatgttcagttccctgggatatatccctaagagtgcgattactgaatcttatagcaactttgcgtttttaaaacagactcttaccaaaatgaaataaatcacaaaggtgtagcaccgcaacagcagaggtggtgagggtcttacatcatccctcatctgtttaggttaacatatatgatattcaaaattaagagcaaactgcttagtcctagaactgcccagttcttgtttcttattgctcagctgtgtacaccatgtctacccagtgtgagtttcagtggaactagaatactttgattgagcaagggcttgtgtgtgtattgtttacttttaaaaacattgtttcaagagggttttttgttgttgttgttggcttggggcttgggggtgatactgaaccaatactcattcctgctttgatacattgtttcctgagccttctcatctcttctctgcggcttagctttcattatttaacaaacatttattgagtgcccgtaatgtgctggcttctgtgatacacacagagaaaattaaccctggagtaacgtgctgagggctgcggtacaggaaagcacagaatgggccgtgcgcataacccggatgagcgccttgtgtcccgctcactttgcgcgttgggctgcaaacagtgaacactcactgaagttctgtcatgggatggaaaattcattgcacaaatgcaagtggaagcagggagggcaggattcttgggaatgacgccagatccaggagacgatcagcttggtctcattccccaccacgaacctcgtgtcccgacagcgtcgacacatcccttcatacacggctggccagatgctcacccgcagtccactcagcggtccactcagctgcgtccaggattgctgggtcatttggaaactgcatagagattcataggcagcttcccctaaaaagggtgatattctgatgcttagcccatctggtacagccaccattcatctcttccttccttcctttaaatattccgcaagtactcatctcaacctcttctcacacctaagcctatcctgataattgtcttttcctccaaatcctctttaatatatttttcatgtcaaaggggaaatcatcttcttttgtaagagaatacatgataaatttattttccctgtgtctcccggatgtctagagcgggagtcaggaaaaggaagcatttttggggggacttaggaggaaagaattcatttttttttttttttggtaccttagaatacagagacagtgatccacattagaaaggtatgggttggactctcctacttccctaggatgtttcttctaccagtgtgggtgacactggagttggggtgggccatcaggagatggaggtgagcctgccccggatggctgccccctgctcaagtgagccagggtgggaggagatgaggaagacagcccctctggctgtgccttttggcccccttttctctcagttgccctaaaagttatttattcctggagttggctttagaaataaataggaagtatcttggcataagtcagagaagggtccaaggcagaccatcttcagacgcagtgagaccctcatcctctactccatcatacacctgttttccattacggagttctgctgtcctctagttcagctctgctctccagcaggctctctcgggtggtgaccagatggccgccaataactccagacttaaatcctgcctgggctgcggggcggacaccccatctactgtgcaggcactgctgttggctcctgtggagcagctgtggagcaggggtgggtggagtagcctctgcccatcctgagggacctcctccgtcctccagttgtggcctctgctcaggttcatatggccacacagcaacactgtctaccttttatgcttctgctgatccctacctctcccaaagacagtaagctcgggaaaaggggacagtgacggtgttagtgaccccaccacacccactacagtgttgagcactcatcacatgtgtgtccgtggagctggcctatatgcgctctccagtatgaggctgtattatgtctaaggatacacaaatacacggctttaaagtaggaatattttttaatttactacaaagaagctcagggattaaagaaccatccgtctcttaattctcatggtcgatggctttatctttttgcatagcgtgcttgcctaaagcgaggcacctcttcatatataaatcagcctttttttgaataaaagttaaatacaacaggatggaaatgcagctttgaaaacctataatgagcaggagggattattatgcatctacaccccggggaagtgaatatttcatgttagaaaaagtagaggccaagggcaaggttcatttaaaatgtataaagataataaaagcgctcatggatggaaaggccatctgaaaggactgttcactttttggagaggctgatgtggaatcattgtgtttctttgcagggggaaaaagaaaaagtcctgtgtgcgaatggccccctgcgtggtgctgcgtcagcagacaggagcattattttcccctggaatgtgcagcgcttggtgcctctgttctctctgtagtgcacagagccaagcagagagagaggctgagcgtttcaaagagagacaaaacaaaaacagattattctgctgtgctgccacatcaccacagcacaatactctgttcaaaattgtctcttgtcaggcacattcttcaaacagtattatgtgtacaaagactctctgtgttggagaatttgcatgtgtagggaaaatagctgcatagtgcggaatatttcctgaagaggccagatttctgtgtgtgtatgtgtgtgccgggcatctgtgtccttagcattttggaaggtgcctgagctttcggaggtcaccaaaaagtactgagtcatcgtgccattcggttaccttcggcgctaccatcctagtctgaagcttttacaggcctctaagaaggtcttcctgagaccccagtcttgttttttgcataagtacgctgcccaggctccggtgattgacaggtgtagaatgggacgtcctcctttcccagttgcatgatacatagtgttcagtgttaatttctggaattcaggtcacttgaaaggccaattcttgggcctttctgcctgaatggctgatgattcctctccttgcatccctcgtgatcaattatccagaaaaactgattattcagattgttaaatccccagttagtccggataatcggcattctgttgtatcccataaatgtggcccacgctgtggagcagggtgggcctcttcctggggccctgtggctcctctctccccaagctcaggcgtgctgctctgtctcccgctgcctgctcttctgggcattccgctctcctccagcgccactgatgcacagcctttccaagagggtggccttgcctctgggtcagctctccattttggggggactagggtggcccggctggaggcctctgcagtctttgtaactgggacaaaagttgaaaggacacataaaaaaaattacagataaacctgaaggcacatgtgctcacatggctgctgtggctgtgggattgttccttctgcctgtgaaatggctgaatttaaaacccatgcttctttgtcctctagatcctgtacccccactttaggaaggggcagcaatcagaattaggcagcctactgtctttgttggggggctgtaacaaagtgccatagacagagtggcttgtcagcaacagaaacttactgctcacagttctggaggctgtgaagtccaagaccaaggcaccagcacattcggtgtctggtgagggctcatttcttggtttgctgtgtcctcacatggcggaaagggcagacgggcttcctcaggctacctgaggaagggcactaatcccattcacaagggctctgccctcctgatccattctcctccccagagctccacctcttaatgctatgaccttgggtagcaggtttcaacatatgaattttgggaggacacattcaaaccacatcacctgcccaaggtcttacagccggtggtagcccaggccagccatctctttactgtacccattttgtctctagttctgtattaggtgttggaggagggaggtcacacagatgtgaaaatgagtcagctgaacaaggagcaggccctgccctggaggagcttaaggggaaattataaatttccctcagtagtgaatcatgctataatctagtgcagggtgcaaatatgtgacctgagggagctggataaagtactcaccttgctgtggagacgtttgacttgcacctggaaggatgactcagagcagagatgaggtgggggagggcattctagggaaggggccaacttgagcaagagcttgtaggtgcgggggcgtgcagggcaagggggccctgttcacttagaacaaaggatcggccaaggaagtctgggaaacaaaccaaactacagaggagcttgagcagagtcgaagtttattttgttccctcgttgaaggtttaaagccgaggagctacgtgatgagcgctgtgttttaggaagaggactccgtaatagagaggatgagccagtggatccatttctaaatgtgtttcttaggctataggaggaggagctttctttatttattccaaaatttgctttcagatgctaatgcgtgtattgtgaactctgagaagagagagttccaaaatgtatttgaccacaaaacctctttttcacggtaactggtgcacagtaggcactcagtgtttttgcatgaccaaataagcaagtacaacaccagcgtgccacagagtgtggttcaagaaacattgcattctgtgaggcgctgaagcaagaagaaaggccagtgagaggctttgatatttatccggggaagaggtactgattgctcaagctaagcttcagtggactgaagatagggaagccaaccacccacaactcctccaaatacctccctctcccaggcaggcatggctggggcacccgcttctgggctctcctgccccctgggcccaccccacggatggcttttcatgcatttacttatcattctcctctggcagagaccggcacggtctggcccgtgggggctcaagacagttgacagaaggaagaggaaggagacctaagggacttggcagctgggtggagaagaagacccgatttctttatttatacatggacttgcttgaaaaagatttctagtccttaaccaaaaaaaagtgcagtgacctttccactacgacatctgttcccacgagatgcaagtcacagttttcatgtaagggctcaaagcaaccgtggagggccgaaggcaagcaagatgtggatcaggctcttgtttttctcttctcttcatcttcccctccccttctaaagtgagagcttgtgattaaggagggtttaatgacagggaaaacagttaaaatgaagaaggagttgcctgaaggaagcatctgggaggtgggcagagcaaggggtaccgggggccctgccatgaagccttcagggcatcggtatggaaatgcctccagctcctggctcgcgctaagcgtacctggttctctagatggctcccggtcttcttgcctcctggcccttccctctcccctcctctgacctttctcttacacttatctttttttttttttttttttgagatggagtctcgctctgtcacccaggctggagtgcagtggcacgatctcggctcactgcaacctccgcctcccaggttcacgccattctcctgcctcagccgctcgagtagctgggactacaggcgctcgccacaacgcccagctaattttttgtatttttggtagagatggggtttcactatgttagccaggatggtctcgatctcctgacgtcgtgatccacccgcctcggcctcccaaagtgctgacattacaggcgtgagccaccgtgcccggccctgttacacttatctttattcccctcatccattcttttctctggactatgttagtgctctggtaacatcctttccctcattcaatcccaactctcctaaacccccttgagtatgttcaccagtggtttattgacatccatctattcttgttctctccaagcccagcaaaaataagaaaacatattttggggtagacagatgctgacccctgacaatttctctttgattttcctccacattttctctttattttttgcttcactaacctttaagccagagtaaataaaaatgactggagatgactgatttgccccagattacacattaagttagtggtgatactagcgccagggcccagggctgactctgctataccatactcccttccctgatggtgcctgcttttctgaaagcttcttgccctattataaaggaagaagcatctactccagatgttgaaaaaggtaaggagcggttatgaaggcccagccctggggatagcttagcattttgcatttagtgcaaacccatttgcagcttttcctcatatttggttgaaagcatttgcattatacagttcatttatgcctttatcataattaggtgcaagttgctgctgcaatatgcttgtctgcattattaccgtacttgcctattttcattcctgctcatcctacgttattgtgtcttactgggttcatgtcaaatcttttcaatgtgtataatattctgctttcggaaatcaggagggggcaaagattgttatgtcaaaaattcagagaaaatgaagaaatgtgtgtacatgtgcacatatagagagaaactgcattgaaatcacagcgagattgtggcagaaatgagaaaacctaagattaacggcttagagggtttttatgctcctggaactcagaaatggtatgtttgcagttgctgcacaaacatggtctaattgctgaagctatttttaaaaagcacgctgaaaccatgaagctagggaagttcaaaggcttgctcttgcatgtgctcagtcatctttcccaactcttattgcaaaatgattttttgcttgaggacagagtgttgggtatctgtgacagccacggtgacatgggctgggaggtgtctccagagcagctccagcagatccctgatggcccactgggtaattaaaagctaagtggaatgttgaaaaaacgtccatacaatttgatcggtcaatttgcttgcttttttgagaatttaaatgagaccttcagaatcatttgaacttttaaaaggaaatcatttcaaaagtcgtcgaaagcgagtgtgtttgatgtgtcttaagtgacgggcaagactgaactcattttaggtggttgttgatagtatggatgcagctgtgaaacttgaatcagaatcatgcgccatccttcagtcaactttgtaaggcacatttctcccggaaatcccacaactgttgattattctcttgtacggccgtggaatctgagagctttcaattagcccctaagggcacgagaagttgagggtattttccaaataacagggtctacatgcaaatgacgtggtaggagcaggggtaggatgagccagagaaagctggagcctggcttctgccccattctctccagctcactcgctgtagaaagccagtggctaaaggcccttgttggagccaggggagtctttggtaggagacccctgaagagcatgtaccctgatgtggtttggctgtgtccccacccaaatctcatcttgaattgtagctcccataattcccacgtgttgtgggagggacccgtggggaggtaattgaatcataggggtgggtttttcccatgctgttcttgtggtagtgaacaagtctcatgagatcggatggttttctgaggggtttcccctttcgcttggccctcattctgtgtttcccacctccatgtaagacatccttttgctcttccttcatcttacaccatgatggtggggcctccccagtcatgtggcactgcgagtccattaagcctctttttctttatgaattgcccagtcatgggtgtgtctttattagcagcgtgagaatgagctaatacatacactaaccaagcaccctctgtggctgactccaagttgtcatggaagttgataaagtacccttgagagcttagtaccaagtcacgtgctgactgactgggttttacacgtcctagccaccttccacccagaccactgtatccaaaacctggcctggccacgttttggataactttttacttacttttttatttagtgaactacagtttatttgatcattcttgatcactttattaagcggaaggagatgttaatctctgaaaagtctatccttttacttccctaaaccaaaaagtgactggagcagatctcaatagatgagaagtttattttgtcaaggttgagggcacacccaggaaaaagaaacacaagtcatagtaggatctatggcctgtgctttttccaaagagggtttttggaacttcagtatttagagaaaagaacaagcaagagtagcggggggtgggaaagagggagggagaggaggcaatgaggccagtggtcacattcctgtgaagccctgaccagccctcagtggatctacattttacatgtgaagaaagggaatcagggaaagtcaattatgattctctctctgcttagtaaatctacactttacatgagttaaagtaaacatgtgacatcatagctgtctgtttgggaacaaaaggaaggcagtgttttgcatgactcagttcccagccctaacttcccctttggcacagtgagtttggggtcctgagtttctattttccttgcacacgtcttagtgctgtgatagaaaaggggtttatttgaactcttgccatctttgtcttaaaagatgatggaaagtcaactgtctgtggatgtgataggcaaatcagttgttttaagcaattcttaggtaagatttaacatggcctcaactaattacttaagagacagctaggaattatttctgtttgcctgtactttgcctctgtatgtgtgtgtgtgcattgcatttctagggaaaatattgaatagcagtttcttttttgaataattatgtattagagaaatttagcaatattcttcccaaattctatatactttacattacccttcattttaccttccagctgatagaagagggaaaattgtagattattaattgatagatagatagacagacagattgtcagggagatggatggatggatagatagataatagaggactttagcttatatagcaattcctgatacaggcacagatgcagactcatagtataaagttgcttatcatggcaagtgcctgacatttcaccattttgatgactattctaggcccaaaagctcacagactgggggcaaatcttttccatctaaaaacactcccatcatcccttaacaaactgatgacaacataattgttttctatcaaatgaatcctgaaatagtataaaacatacaaaaattcagtctgtttcatggagcatacaccttcaaaattcttttcaggcttatttttgtcactaaataaaaatcaatcacttgaaagcatacgtctctgatttctatcccttgtcttataggcaggtgtctctatttccaagtcagcattcattatgcacttagctaatatttattgaacctctgtgttctgttggtagttatgagtgtgatgcaggggtggctgggatatcaggtgtcctctttgagggtttctctccagggtagacgggaagcctcattgcatccagggtacagaaaggtgtgacagattccccaagacacgggctgcactttggggcactgtggaactcacaggtgagcccctccctgtgctcaggggcatcaggttgtccttcaggggccagcaggtaaaacggactctgagagcagaggcctgctaagaaggaagtgggggtgtgggcagtcaggaagtcatggcttctgtttgagtaaagcctgatgaaccacactccttacccagggttagaggaacgtctatgggaccagctgtcaaattaaaagcataagtcacacattctatttccagagcccacaaggaggaaaaactgagacttcctagacatgaatttcatttctgacaggcttctctcctgctacatacatgcacattatctacacacatgcacatgtatgtagatagcgtggcaagtgcatgcacacacaattctgcacacacacctcctcctgcactcaaggtttctggtctccatacaaagatgggaagatttggggctcagggattttgatcaaaccctcggtaaagcagaaaccacctctgttgtacttctagttttctgtttcagggcccaagaaagtccatttcaagggccttatgtgtaattcacagttttgttggagtccccttctaggtagacaaaacagaggaacctttcttagactggatctcagttcagccatcccaggggctaccctctcacctcaaactcaacagaagatcaggaatctgggggtagcatgggccacgtgtcttccctctcaacaccgcggtaccctggagcaggggttcccaacccccccagccacagactggtatcggtccatggcctattaggaaccaggctgcacagcagcaggggagcagcgagtgagcaagcaaagcctcatgtgtatttacagctgctcccatcgctggcattaccaccagagctccgccccctgtcagatcagcggctgcattagattctcgtaatagcacgaaccctattgtgagctgtgcccgcgaggcatctaggttacacacgccttatgagaatctaatgcctgatgatctgtccctgtctcccatcacccccggataggaccgtaattgcaggaaaacaagctcaaggctcccactgattctacgtgatggtgagttgtataattatttcattctgtattacaatgtaataatcatagaaataaagggcacaataaatggaatgcacttgaatcatcctgaaaccatccccccgacattggtagaaaaactgtcttctgtgaaaccagtccctgtgccaaaaaggctgggaccactgccctgaagcactcaggagacacctgcatgccactcaggtctctgcaggaaatgacgctggaccggcggttctaccgagagacttcctgtcttagttggccccatttatcctctgacggtttcccacatacatggcttctcacactctattcttctcatggacatattcgtgccacttgcagttccacatttcactgcttttcagattgatgtgttaccggagaattattcttctatctattattattataacattcaccataatcatcattagcccattaactcataactattactatcattgctaatataatgactgttaactaaatatgaataatgtatgctatcactaatataattactattattaactatattccatctcacataatctatctcagctgcttcatctccctctgcctcctttcaccttccccctgcctgatgttacaaactgaacaacttagagttccttgaatattccatgagcccggcttctcccccaggccataatgagggtatgtcagtgtgcagtgcacaattagttcctctgccaaggcaagatctggggtgcatggccggccttgcagcccgtgtgggtgtcccagtcttgctcttgctctttaagtcaggtgtttgcctctgctgctgccatgggaaccatctactgctgcaggtcaggcatcagaaaagttgtgtgtcctgccctacacccgtcaagtgacgacagatgacaattggaggggaaggagaggaggtcagaggaactggagttgcactcgtaccctccctggtgaactgaaagagcaccctccctggtgaactgaaagatagacaatatccataatgtcgaggcattgaccaaaatcttaccacgtgttttgtgctccatagaatctatttcaatggagcaccggctcttagagcgcttaaagattctgctttattaactgactccatgttgctctactgggccctgtggagtagttaacagctgttagcttgaaagaacgtatggttttgttgggaactgtaaggtgtaattaattcattaggacctgctacatgtcagaggctgcgtgagacaccgggctgcactcatacctcacgtctcagacacagacttggacctcagggaggtcacatccctctgaggaagagaccagcaaaacaccaatcagatgtgaccagtggcactggccactagagtaagcacctgggctctggggtcacagcagagggggcaccaccagctctgggaaggctttagggagtggatggcaattagaactttcaggatgaaaggatgtggttcagaggactgggggagagggcagcacagacagacgaagccacgtgcaggggcactgagacagctcaggaatggcggtgagttcacccccaccgggtcgtgtccgggaaaatgatggagagcagcactgaggatcagcaggggaagatcacgctgtgcatcctgagtcttctgggcttcatgctgtgggtcggggtgattcgttgaaagatcttagcctaggggtgttttaggaagatggcacaggctgcagcatgtagaccaatctgaaggaaagatttgcagtcttgcaggtgagatgtcattaggccttggactgagacaggagtggtaagaggggaacatacttgggagtctggggggaaggtcaaggtcaaggtcagcgggatttatgacatggtcatctacggggagaaagagccagggagtagcttctaagactgtgtttctagctggagtgactagaggagtgagggtgatcttttcagagctcaggagtatgtaaggaacagattaaggtgggagggcaggaaaaaagacaaaacagaagttctgcttggattcgttgcattctagctgccaagatggaactatccggaggcaaggcggcacttaaactgcaagctggggctgcaggtggagattcgggagtgactgttttaggattaatttctaatggcctcagataagatgacccagggtaaagggagactatgcagagggggagcagtgagagtgaagaggaggataaataacaatagatggcattgcatgggacataaagtgactgctcggaggttatttacgggaagatggatctcgcaattgagtgctgaagaaggcatttggtaacaactggagccccttctctgtgccaggagcgggcactgaggggcacaagtgattaaataccacccctgccctcaaatgaaagccaacatagaaacagataaactatagatcaagtttgcaattcctagagttgagatataaactaggtactatgggaacacagagctcatttttcttttttattagatgagcaataagtgttaaatgtagaaaaattagaaaatacagagaaacagaaaggacatatatgtaactcataattctacaacccagacatgtggctatgaacattttcattcatgtctcatacaaataaaaaatacattttttagcaaaatgagatcatacagcacacactgttttgtaaacatttttacttcatattttattatttctgtagtattaactatgttatcattttcaataactgcctagtttctttttttagcaaatgtatcataatttattaacctgtctccatcattggacatttagattggttcctggctttcaccacattagacggaatggcaaatattcttgtagctacatatatgcaaacatcaacattatttctttacaataaattcccagaagtggaattgttgtgttacacgatgttctagttaagctctttagctataagaactagacctctcttctctatagacttgctagctccagcttaaaagtagagggaggggatttttatgaacaaaaggaaatgagggaatctaaaggcgccaagaagctgattcctgcaggcctgttgagagactagaaattaaaactccccgggccaggcacggtggctcatgcctgtaatcccagcactttgggaggccgaggcaggaggatcacttgagcccaggagctcaagagcagcctgggcaatattaccagaccccatctctataaaaataaaaaaaatcaggtggacatggtggtgcgtgcctgtggtcccagcttcttgggaggctgaggtgggaggatcacctgagcccaggaggtcaaggctgtggtgaaccgagatcacaccagtgcactccagcctgggcaacagagttaggccctgtctccaaaataagtaaataagcaatgaagctccctggattccagcccctgttactcaggagccgcagggcctctcacccatgctcctctgtgcctctctgccacccttctcttctttaccagcctggtttgcttacttcttttgccataagactcaattttatgtcatggcccctcagcttcagtggctgacggtagtctctgccttttagttaagacgccggagaaggtgagtctgattggcagattcccaccagtcctgagttctggccagctaagctcgggcagccatggatctgggggctgggagcaggattcagtcgggatgtgctggagcccacttaccccagctagtgagagctgaccctgggcacctcctcccagctccaagttcactgacgtcatattgggagcttgaaatcggctgtgccggatttacttacagcaagaaaaccagtaagtgctgagtcagggctggtcgtgagatgttcctccgaataccactgggtgtcacatggaacaaaactctctgactccttgagaaatgagtatggccagtgactgacatctttagaatatttctgaaacaatgtaatctcattaacattccgtagatgttacttcattctgttattgtgtttaatgtcccagagaagaaatctagttttgggattttcatttcttttctttagattgatatgttgttttatctgtctgcactcttgtcagtttgatttgcttacaaagcgtgcacgttttactgggctgcaactgtggtggggcgctccctttgctggttctcagtaagtccattttatttgaagatgcaaatctttttccaagtcggggaagtttttccacgttgttaatttgattaatgtgtttctttcacttacagtgtattcaccttctggaattcctactgtgcttatatttgatcttttgggtcaatcttccattttgcttatcttttcctcatcatagctaacttaatctattttctttgaattctggagaaaactcttgattccagccaggttcactgatttgattgtatgcactatccagtctgttctttcgagcttctgttgcattgttaattttggcaattgtattctcatctgaaagtagtcttttctgatctcagatgattccattttcatatttacagtgtgttattgactcctctcaatgagttatttgattcagattctctggttgatctcaagcagtgtaattcagaaatttcttaaatgttctgtttcataagggtgatatttctttatgttctttaaattgatcccattattatggacttttttttttattatgagctttattatcagggctacttcacttttattttgccacattaatgaatgtgcaggctgtattgagagcctacagttcactgcaattgaatgaagggaggtttgttacggggctaaaggaattcctttccctgtttgttttaataatcgagaagttgcccgggctctactcttctctcaccagcacttagtgtgctcaagaggttctctcaatggagcccgggactggcagtgtgggcatcccctgagtacctgccagaaatgcccggtccagaggcaccagctcagaaactctggtatggggcctgggaatgtgtgtcttcacaagtcctccaggttggtgccatcaaagtttgggaagtgcctatttgctcaccactgggcttccagccacagcaagggtgagccaggtccaagttcacgtttagtcccctcatggcaacatctgtgcactttcacgaggcatttgcagatttgcccagcctgtacctcagccctcaagctgctcctacccggaattctgacctctgtggagtttgcagggttcctcaggggttcctttcacttcgtgtccaggtggacttgtcttttgcgggtggggaatttcaggttgggcagcctctcccttagacagggcttgctcatgctgtcctgcaggagctccagtgtgggtggtcgtgattttgattctcagcagaaatgcagactatttccctactattttttctttggatatttctatagagatttaggaagaggtgcagaatgggaggctcaaatcacctggaggcagaaattcctctttttttttttttggatgacctaagggagatttacagagtaaaggggacgctgttgtaaccatccaggtggggatgaggagggtctggcattggggatggggaaaaggtggactcctgagtatttctgagatccagtggatcagcctgaggagcagttgcgtggaaggagaggatgagttaggatggctcagttcattcagttacagtgaactgtaggctctcattttctagcgcagctgccctgatgacttcttggaagacatcaaattgtgtttgacttgggcagaaggatggcactggatgagtgaatggatggggtggccattcccaaccacagctgagcacgtcgtggtgacggggtgtgatctcccccacccctgctgcacccagagctgtcctggtcacatgcacattcactgtcagacgacaaacagggagaatgaccgatgctgccaggaattctgtttgggtctcgtacgttatcatctgttaccagtgacagtagtgtttgggacatttcgccagcttcccggagaaacagccctttttcctcggcctcccggcacctgcagtccgtccgtagctttcccacaacccatccctcagagagttctggcatgctaattttcaggtttaccaagtggcatgaaagatactaatgaatttctttacccgtcgccctcctcctagctgtcatagctcttcccacttgaagtgtttgttttccttgttcctgtgtgtgtgtgacagaggtgaggggtctgctgccttcatggtggacgactcacttgtctggtgcttcaagcctggggtctgccttcctaataatggccactgtcattttcccccagctggaggcctgaggacatcagcttaagcctctccagggctctgggacctgcaaggtccagactcttaatgtgattcttgacaactgatttgtcagctcattttccccttttctcaatgtcctgttgtagctcagtctgtctgcttgtcctcagcgtgtaataaaacaaccccagacaccccactccaggaaccagggccccagagctgtcccacagcctagtttaggactgaagccccagatggcaccccctgccattgggaactctaaggagactgaacaggaagaaacacagagcacatcttccaggaagaacctttgataagctgagaactctttgccctttatttaaaaagtaaaaagaagcgaggaggagaagctgcgtagaagccctgccctctgagtttgcttagaaaaagcacattcaagtttgcatttaggaatcgcagtcagtgacgcatgcttgggttccctgctcaagctgttagggcaaaagcgacggcgtttctaccctcatcaggagagactgcctctatgaatctctcgtcgccaaactaagcagttttaatccagatacagagtggagacagatgaacgcatgcaggatgcttctccagagacggcgtgttctcgctgttgtcagccatccagacagggtgctcagagggcagccttggggcaccctgcagtgggcaggcagcatgaggcacacggatccttccttctcttttcagctgaagaaatgctaaagagaagtttgtaaaattcagagcctcatctcagagggaaagatgagttaatgatctgctgcagaaggacttggcaggtgcgtgctccagccggctgagaagacacccacgcagccctcccaccatgctgaaaaacatagggtcagccattggcactcccccttttcccattgatgaaacggaaattatcttttggaattgtgctgttaacaatactctgtattgccacaagtaggtttttgcaatatgttgaacaaacgtgttatcccttttcaggtcctaaagtaaagagggtctcaggagggtgtaagggcagcacgtgagagtgtggcctgtgaggaggatgttgagtgacttcagggaaatcagtgtcacctatgcagagtcacaagctggctttcctagtcttccagcacctggataaatccctttttgtgcaacaagcactgatggagtctacagaagcatgcattcccgtgggaagggcatggctttggtgctgagcctctagatggtacagacaggcatcagggaccctttggccactcatttaaaccctcagccagaaggaatgaaatcactggggctgtcatgagcaatgaaaatgacaatctgcactttatagacacttagcatagtgtctggcatacagtaggcacccaacataccttgagtctgttatgttttgtctatcagctgttacatttgtttctattgtcttttctccagttttctctgggattggttagagtgaaacgtcatgaaattgtttttattttattttaaagacaggatctcgctctttcacccagtctggagtgcagtggtgtgatctcggcccactgcagccctgacttctttgggcgcaggtgatccttctgcctcaggctccccaggctggtctcgaactcctgggctcaagctgtctgcccaccttggccttctacagtgctgggattgcaggtgtgagccaccgtgaggtcctgttttgattttagactcatcccttaaagcccaggctgtcacataccagccaccactttctacgactccgtaaggcacggtggttcagaacacaggctgtggcatctgcagacctggctttgtgttcaggctcaaccacttagcaactgtgtgacccaggccacatcaggcttcttacctgtaaaacaggaaccacaggccttttgcatttaggggcaagggtaggcagatgccacatttccagcaggacttatgggacatgaacttaataaaagtctgctccagtagcctgagcacctttagggcttaacttgggggcccgtcaatgcctccaccgcgctctcagccacagaggaattcctgaactgtccaccagtggggttccgttatttcctgtgatgggcaggtagggctgacactctgttctccagtgtagatttcatagtttggatttgggcggcccagaaatagcctgcgagatcttactgaaccaggtctgacgtcatcacactaaatggaaaaaagttaggaacgtgctggtattccagaattcttttcttaaaaaagtaacgttccaaagcaaccatattgctaattgaaatagaattttttttttaaattcaggaaatgttgggccctttagtttccctcctatttttcattaggtattttggagcatttcatttattgagcacctaccgtgtgctggctgctgtgttatatgcatcgtacatattttgttctcacaacaactctggaaaataagcataaccccttttctcctgtagtaaaggggaacttggaaggaaacagaagcctgccagggtcagagagctcatgggcagccaaggcaggacttagacttcacagtcagaggcctcaaagcctgcgcttctcccgtgacactgtcatttcagagggtgatggtccaccatggctgaagaccaaattcagccaacagctgctgcagccaagagtccatctgtctcctctgacactgtcatgtccaacctgtttgcctgaacatactttggccactttggagtattctgctcagaagtaaaaataatgtcgtcaaatttcataaatagatttctgaggtatatacttctccgcaggaacctggctcacttactgtctttagataatggaaatcgtggttgcaactgaggttctttcctaagttaacaaatggttgttcctcaccgcagaactacaggaatgacccttacaaatgagcagattctttgttttctcttgattgctggcagcagctgctgtgggtgctcagtagaggaatgtttagtgagagaaactgagctagtgttgcagcagaggaaaaacactaggaaattgacgacttatctttccatttgcaccttcagaaataggttaattgtttcagtgactgcctctgtcttgattaggaagcattaatagcaattaatgatataacttcaaaaaaggtataggaaaattaatagaattctccgttaatataaattatactcattatctactgtatccagaaccatcaggcctgccaagctcgttgattaaagtacaagtggagttttttcggtctgaattctctagatagttaaacctttatttatttatttattttgcagtataaaattccccacagtgagccaatagtattatttagtttaaaatccctcaattctacaacttagaaacctttcataagttaattttattaatgtacacacattttatctacacgtacaaatattatttgatggtaatgatgaaactttgttaataaaggatggtgaagaaaagttcaggtcaaaaaaatatgaaattgtaggactgattttatctagctttaattctactctgcagtagaaacagaaggcttttttggtaggcagacgccacatttccagcaggacttgtgggacttgaactcaataaaagtttttttttggggggggtgggtggaatgccaataatggtaagaataacaatagcaacaatgatagcaaaggcaataaccaacatcccctaatctgcccctaggaccaggttcagtacctcacatgcattctcactaatcttcacacttacaggaatcttcaaggtagagggtgttaccccgctttacagatgaggaaactaagtcccagaggtggtcaggaactggctcaaattcagacagcaaagtggcagagctgagagtcatgcccaggtggggaaaccccacgcgtgcattctgtcactcggctgaactgcagcacagccctgggcttattttaagaacataaaacctgtctcactagacccaactctctgccctgttccttattctttctcagtgtcaccagaggacacatcagacacagttagccttccccatgtcaactctagatggagaggaatgcccctcgaaggagtctaggctgcctcaggattttactatgggtgggaaaccaatgcatttgtccttgcccttggttaaacggttatctgaagttggcttatattcatcctcttaccatccttaacagcaagcttgccgccaaattccgtcactgattattttgacttgatgaagcgttgctcttgatctacagattcctcggtgtgttgtggactttgatcgcttggccagctgtaatctgccagcttgaacacgattgatcttcatgcaccaggcactcacacctgcccatttggcggggttgcttatgtctttctcacaccttctagcttgttctttcttttctggagatccaacaatcagaaaagcattccgtatttattccttaacttataaggaacctataaatagggctcctgtgtttcttttcttttccccaagactgtgtttgaaggttaatttcaggattttcttggcatccttaaagcggtgggactgttctaaactcctttgaacaaaatgttgattgaagtgttatcttttgtaatatactcctggagggttgtagggatttggaggaaaggtcagagtgatagggagtgttttggaggaggtgagatttgatccagcccttgaaggatggtggggtttgtggtgctagatggctgatgaggtcatttgtagataggtggagaggtgtattagctggttttgcgttgatagaaaggaatacctgaggctggtaatttataaggaagctggctcacagtcatgcaggctgttcatggtgccagcattgctcagcttctcttgaggcctcaggaagcttttacccatgatgggaggtgaggggagccggcgtgtcacgttcctgaaagcatggtgtttttattttttatttatttattttctttacctaattggtaaacaggtgaatgcagttctacttggagactcagcccacccagcacagaacttctcacactgaatgagaaggcgctgaggtgatgtatgtgtaacccaggcagctcgttaacatttaggtcctgattcgatgggtctggagtgacacccactgagacttcgcctttataaccagctcctaggagaggtctgtggtgctggttgttgctccactttcaggaacaaggagctgagtaactcaccacgtgctggaaaacatgcccttttcttcgaataactcagaactagactcccagagcatggccagagccctggcttcacctgggtgtggagtggaaatgcagggtcttgattccaccccagccctgccgaggcagaatctgcacttgaacaggatccccagctgaatcacgtacacacacaagtttgagaagcactgacatggaagaggcaggtctcaagaataccagtaaagccagacgtggcttccagtaatgaaagatacaggtctcaagaacagcagtaaagccagatgtggtttccagtgctcagagactgaaaatcctggcatcaaattaagctaattcgtaagtgggttgaaattaattaatcagaaaggacaaaatacaaaaaaattagccacgcatggtggcacacacctgtaatcccagctacttgggaggctgaggcaagagaatcacttaaaactgggaggcggaggttgcagtgagctgagatcgcaccacttcactccagcctgggtgacagagtgacactctgtctcaccgaaaagaaaagaaaagaaaaaagaaaagtctctctgagtaaaataagagttgtactaggtttggaacaagaaaagatatttataaatgcatttaagatttgtattttcagcatcagttagaacatcttatctatagccatttcttagaaaagtctagttgtaaaagaacagtgatttttgcacatcttgctgaattatttttatttatgtaaataatagcagatggacatgtataatcatttcttttctaaataagtgtgcataaaaatgaagacattggagagcacttctaatccgagagacgttataaggattcagccaaagacaggatccttggggcttcggttcctaaccagaggggcaccccatggacgagcagatcaacccattttaattttttcatgtcttaagtaaaaccagagcttctcaaatgagaaattcacaaccaaacacttaaaagtggtagtacccagaatggaagaaatattctatcagtctggggcattttctttcctcacatattcctaccctaagtgcaaatgttcatacaactatattgatgaacacttcctctgccatggttttagatgatcaatttcttatttgtgtcatctttgagaatgacagactctgaggttcaaaaccttatggggcttctatcctaaccaacatcaaggaactataagtattcaacgtcccaaaacaataaagagtaagtaaacaactgcgtagctaaccaagtccctcctttgttctggaagaataattttgcgggaaatccttgctttctattcaggcatgtggggtacaccctaagctccttaaactccccgccatcttcctcagtgatatttgctcagcatccctaggttgattggtctatgctgtggatttgagctatgctggttaccaaagtgcctagtttttttctctttccctctccgtgccgacttatggggcgttttacttcttatgtatgagtttttccataggttgaacagagaccaagtgaaatttttaaagaaacaaatgacgctctcctattagaagctttgggagaggtttggtagaagtgcctattgtaattgacttgccataattacttttggattttctataaatttgctatacagctgttattcatgctgggcatcaccctgctttaaaacggcatgagttgctgggtgcctgaaccactcttactgttcattggtttggattgatagtttgcacagtccagatttgctgagtaatcattgacctgccacgtttttaataggcccacactgaccagcttggttcttaatatatttgaacaatcacataaatggaattaggacttcattttttattcacctgccttccagtctatgtgaacagactacttatgtttctagcagcagtagctcccccctcactaatgcttgtgataatatgcccgtaagtgagtatcttaggagggatcttagctgtgcttttgtgcacttcactccacacatacagcctccgcctggtgctccctccctctctctgtcgtcaactttagatttattgtcagtgttgattttcaaccaaaatatagatgagattgtgttgacatttaggaaaaaaaccttgcttcgtagcagattgagtagagaaccagttggtttaaatagataaccttgggtcatatcagaaaatgccttgttctagcagagtactctattcttgcaccgtgggactgactttattcatttaaaggaagctggggcagacgggaaaagaaatattttcttctctgaagacttcctgatttgtttgtacctctgttgtgacacccaagggtaagtctgatatagcggtttctaacaaaatgaaaagagatgggaaaacagaagaggaaattcctctccagttgtgaattatcgttcttcactatcaaagcatccctgtgcctggctcgttctgtggccttgttttctctgctcctggtccaaaacaatgacccacccattcccagagatagacaggagagaacaatgtgtacacaaaagagagggacagagagacccccaaaagaagccaacacccacctctgtctcacctgtgtgttcagatagggtgtggccgattgtgctgagcctgattatttacgcttctcagaatcagggctctccactcaggacagtgaatccccaaagaggctgagcccagaacctgccctgggggcagctggtgccaccgtgctggtagacgacacagcccagccaaagccacctggagatgagggtagcacaaatcctctctccatcctccgcatcctccggcgggaaatgctcctggatctttttttttttttttttttttttttgagacaggctggagtacagtggcttgatcatagctcactacagccttgacctcctgggctcaagtgatcctcctgtctcagactcctgagtagctgggactacaggcttgcaccaccactcccagctaatttaaaaaaaatgtttctagatacagagttttaccatgttgccatggctggtctcaaacttctgggctcaagtaatcttcctgcctcagcctcccataatgctgggattacaggtgtgagccgctgcacccagctgatcctggtgttcggacacgggatgctgttccattcctggagctgttttggaatgaacgctatcaaaggatgtggttagcttcagttgtttactgctcctcatcattttggaacattgagtagtctgtcacttgatgttggttaggatagaacccctgcaagattttcttcctcagagttcatgctcctcaaacttgaaataaacaagacactgattatctaaaagcatggcagaggaagtgttcattgatatatttgtataaacctttgcatttaaggtgggaatacgtgagaaaaaaagtgccctatgactgataaaaatatttcttctgttccaggtactactgcctttcagcatttggttgtgaatttctaacttgagaaggtctggttttacttaagatatgaaaaaataaaaaggggggtgacctgttggtccatggagtgccctttgtggttagaaactgaagccctaagaaacctgtctctcaaaaggttggcgcttggttctgtgtgtttttcccatggctaggggaaggtgtggaagagaaagctttctgtttggtgttgttcctgttaagaaagtcttcaaaatgtaacaaacagtcctgggggcattcaccagccgcacggcatccaggcaggcctctttgtaactagacggtgaatttaccttctgcctgaatagcggtaatttctactctgtgagttgaacagtggtatctgtagcaagagaaaataacttcaatttagtcaggttttctaaagatcttccttgtattttaaggaggggccataattgtgaatttcaagatacactttctgaacagactgtgacccccttccctcttatttatctccttttttctttctctcctgtgttcaaaccatttgttaagacaattttctgttttctccagggactggggattgaatgtctttgttcttggtttatctattaaagacacttttctagttacagatactgtttgtgaatcacaggctatgcaaagaacatctgattatcagcggactggagcccagcaaacagtcacaaacatcccagagctttcctgcctttctgaaaatgtgcatgcaaaattcttgacatgaggaagttgtaggaacaggtgttgatgtctatttggaaagtgtaaagttacacttatgcaattttagcaaacatctattaggcacttactgtttgccagatgctctgaagcatgcagggatccacaagtatcacgtgccttccaggaatttgcaaggagtggggccgataagcacgtgtccaaatgcgcaaggctgaaagagatgggctcttgtcctactttccccagaagtagagcctgtgagctcaacaaagatgtacgtgcaatagtgcactgagcggtgaccccagaaagtgtgagtagaggagtgtgcaaaggacacagcatggaaaggcactggtgagctctcatcagtgagcattcatcagtgtggtgagcagcgaggttcagccccgaggcaaccccagggagactgtgcaaagccccttcggtgttgcttacccaaggaggggaggaagcctggatatttatgcatcaactcccctcttgtattggcaagaacaactttgagagcattcttttctgtctgtctgcctcacctttgtaagccggtcatatctctggccacagaatggcctttggtaggaactgatgggtacttgcaaaaagccctgggcctgttggtgaatggtgagtgccagggacgatgggcagggcacaggcagcacctgccacaaagccatattaacagagtgtagcaggtgcaccccacacctgacaccgtgtacaaagcttaatgcaaaatgggtcaaaaacctaaatgtgagacctagaactataaaactcctagaagaaaactttatgacattagatttaggaatgatattgataacactaaaagcacaggcaacaaaagaaaaaatcaaaattgaaaactcttctgtatcaaaggacactgtcaacagagtgaaaaggcaacctgtggaatgggaggaagtatttgcaaatcacatatataataagggattaaaatcgagactatacacagaattcctacaactcaacaacagaaaaaataagctgatttaaaaatgggcaaagaactggaataggcatttctccaaagaagagatacaaatgactggtaagcacatgaaaaaatactcaacatcactaatcatgagggaaatgcaaattaaaaccacaatgaaagaccaccccactccctttaggatggctgtaattcaaaacagaaaacacaacaaaaacagaaagtaacaagtgttggcaaggatgtggagaaactggaacgcttaggtactgctaggagaaatgtatgacgaagtagcctttggaaaacagcatggtagttcctccaaaaattaaacgtcaggttaccgtatggtctagcaattccacttctggatatatacccaaaagagctgaaagcagagagttgaacagatgtttgtatgcctgtttatagcagcactattcatgctaattagaaggtgagaacaatccaagtgttcatggacacatcagtggataaactcaatagagtccacccacacagtggaatacgattcattcttgaaaaggaaggacattctgacacatgctgtatcaatgaaccttggggatgttatggtaagtgaattaaggcagtcagcagaagacaaatactttgtgattccacttccatgagttatctagaatcaagttcacagagacagaaagtaggatggtgggtgccaggggctggggaggaggaagtggggagtgagtgtttaatggggtgcagagtttcagtttgggaaaataaaagtgttttgggccgggcacggtggctcacgcctgtaatcccagcactttgggaggccgaggcaggcggatcacaaggtcaggagatcgagaacatcctggctaacacggtgaaaccccatctgtactaaaaatagaaaaaaaaaattagccaggcatggtggcaggtgcctatagtcccagctactcgggaggctgaggcaggagaaacacgtgaacccgtgaggtggaggttgcaatgaccctagatcacgccacagcactccagcctgtgtgacagagcaagactccatctcaaaaaaaaaaaaaaattttggagatgtatagtggtgatggctacatcacagcttgagcgtccttaacgccaatgaactgttcacttagaaatggttaaggtggtattttatgttttgtgtatttaaccccaatggggggaaaaaaagaagtataccaaagtacaaagaggaaaggccactttaatcaagggtactgggaagcctgcctggaggaggcgctgtgtcctctgggccctgctggatgggtgggatttcaggaggcagcagtaggggtggggacgagttaggaatggagagagctgttacaggtggggacactcaggtccgaggagggcagaggggaatgtttcagagaatgccacacggtcaggtgtagccgaagctcaggaatgttggaactcggagaggctgtgaaagagaagccctggctgcctggccatgatcatcatgtgcctggtcttgactggcatgtcaagaatactgtccgtgcagtggcgtgtgccccaggagcacggcagttctcaacaagactgcaccgagatctggagatgaaacttctcagctctcttacatttggccatgcggaggtctacccaggaaggacagccttgtcccaaggacctcactctgttcactcaacaggtatttatgaggcccctatgacatgtcaggcattgttctaggccctgggaatgtgggcagaacagggcagatgaaaatgcctgtgctcatggtcatgcgttccagtgggggagagacagacatgaacaaaaccagcacaagtcattcttcagatggagctgagaaccacggggaagaccaaaggccatgcggcagaaccacccagcctgcagaggcgggatcatcagggcagtgtcctcaccgctcttcttaaacactgggcttaacaggaggcttttgtggacattaaaaacaaaatcgcaggtccgtttggatccctccattccaaggtttaaacacaatggtgttcgctggacggatctaagaatcttagccactctgcctagcagcctctcaatgttttgtgtctctcgtttcaactttgaaaagagctttgtgccagggagctcctgcagtttgggtcgaggaggaccaaggcttcaaaggcccctgcccgcgcgtcctgcaggttcccattgtccgtgttaatagcctcagatgggcatcagttgccctgatgggcttgggctccacgcccgggcttgcatgtttggcaaaattactcaagagcatttcttttttttttctttgagacagagtctcactctgtcgcccagactggagtgcagtgacgtaatctcggctcactgcaacctccgcctcccatgttcaagcagttctcctgtctcagccttctgagtaactgggattacaggcacctaccaccacgcccggctaattttgtatatttagtagaaacgggatttcaccatgttgcccacactggtcttgaactcctgacctcaggcgatccacctgccttgacctcccaaagtgctgggattacaggcataagctaccgcacctggcttccaggccatttcttatcacagctaaaagtgatctgttacgtggctggttacattctcagcaactttagaattctattcagaagtggacctaatcttgagacaaataccctcttaccccttggtccactgaaaagacttatgatcccagtctttctattggtgatggttcttctattcagtgggagattatgcatttatgtgtttggatagaaattagatcctcagcctggcacggtggctcatgcctgtaatcccagcactttgggaggccgaggcgggaggatcacaaggtcaggagatcgtgactaacctggcgaacacggtgaaaccctgtctctactaaaaatacaaaaacaaaattagccgggcgtggtggcaggcaccagtagtcccagctacttgggaggctgaggcaggagaatggcgtgaacctgggaggcggagcttgcagtgagccaagatcgcgacactgcactccagcctgggcgacagagtgagactccgtctcaaaaaaaaaaaaaaagagatcctcagctgttgtttcttgaatcagatatttggatcactctagcatccaatcatgcagctcctaaatatgctcctaaatcatgcaggtccaatcacgcacctgttttacggtttatcaatttgtgctcatcctgaactaaataaacaaatccatgagccaactgcagcactgtcttttatcaccttcgtttttctctgcccagtaaaaagctgaagaagatacattctttgttaccttccattcatttccaaatgtgtaacttttcaaatatgttataaatgagaagaaaagaaactgctggattgtcaaactgtcattttatttatcgtctctcgtcagtagaaaagtccagaagcagtgcgttgagatgaaaatgaaggtgcgtgaaagagagaattggaaatgggatatacgaccgtatttcctctctttccctttccctccctcctgctgggcaggaaacgagaagaacctagtcagcggggaatacctgtctccagggaattttttgggattagatcttttggggttgggtttgtgagggggcctgccctgtccccacacatgtgattcctctcactgcacaatcctgatgcctttggcattcgtgattgccttctggatgatgaactataaaggaggcagctcttaaaagaatagaaaatgtcttccagacacaacaaaatatacactcagaaatgtataaaccagcttcccacgtccaggggctgggccagtacagattaagaaggtgaacgtgtggaaggtaaagggtgggaggaattttctatttcgtgaacttgtttttttcttgttagaaaggaaatcacagtgtatttcagtttccacaataaagtgcatctcagaattgcccaggttctgccacaagagacttacctcttggtgggctggggatgacctggatctccctgctgcctgcacgtctttcactttggacattttaagaaaaaaataataatgtatctgggttcttggagatatatacatatatatgtgtatgtatatctgagtctctttaaaaataggtatcccgggagcagagccacagcctgagctatccagatgcctgctccccttggtggaaagagatccgacacacctgttgctctgagatgcttttgcagacaggaaagctcttaattcctttgctaggccattttaacaatgcagagaaaggtgacagtcttcacgtagtcccaaaggcaattaataagcaaaaaacttacctgattttaagtgaagtgtcacggagctgtcttcacccagcccatgaaaaaccaccagtgcaccttgagacgcgtaggcaatgttcaaggccaggaaagactcaccagttcctgtgcttcccattgtcagaaagcaggtggaggatggccggagccaccctggctgcagaaactgacctacagaacttctcattgtcagaaagcaggtggaggatggccggagccaccctggctgcagaaactgacctacagaacttctcattgtcagaaagcaggtggaggatggccggagccaccctggctgcagaaactgacctacagaactgaacagaatagtgattcaagttggatatttagaatatctaaacgtgctttgcgggacagtgaaaccctgcttggtggaggtcaggacttctgcttctgtatagctctgcattccttagccaccgtcctgcaaggcaaacgcgaaaacgcatcttaaaactcgagcagaagtagccttggttgtatgcctgaaaatgcctgttcgtttggaaaaagacaatagcttcccgttttatggcatcttcttcttccttcccagccctggccatcgttctcactgtcctcagcggactccctgggcctcctctttaaaggtcagtgctgaccgggtgtggtggctcacgcctgtaatcccagcactttgggaggctgaggcactttgggagaccagcctgggcaacacgatgaaaccccgtctactaaaaatacaaaaaatagccgggtgtcgtggcaggcgcctgtaatcccagctactccggaggctgaggcagaagaatcacttgaacctgggaggtggaggttgcagtgagccgagatcatgccgctgcactccagcctgggtgacaaaaataataataataatagtaaattaattaaaaaaataaaggtcagtgctccctggcttctctgcaggccatctcctgtgctcactcctcacactctcatggagtggcctcttgatctcctactttcaatcaccgcccatgtaccccctgaacctgcgcacctgggtaccccgcaggcacgtcttaggaagcttgggcagcttctgcagaacgccttcccttctccctcctgacccaccagcactgccactcccagacccccgtctgtctcctgagctttctcccttataagctgcccagccacccaccaagcagctcaagcgagaaacctggagagaagcaaggggtcttaggtgcctctgtccctctctcctctccctttgtccccttctgtcatactcacccccgtctttcttcctcctcttagcaacacccttgacccattggactttgcagccttttcccaaaccgtgtggtaggctttggttgtggctccctgaccgtgctcccacccgctctagacagtgtgcaagcctggccatggctttcctccttgacgcccttggctgcctctccattccctgatggatcaagtccacactcctgagtgtggcgctcctgcctcctccgtggccagctgtggccacgcccatgcccccccactgcccctcaaccaccaagaactgcttcctttttcccaaatgggccaaacgggttccctccttttctcctattcctgaaatgcctttccttccattgtctgactgggggatgcctatccatcttccctgctcaaacctttcccaatttctcctggaagaactgacctcaacgccacacccacactccacggcctgccatctcccttctctttggctttcgtagctccgccacaatgtgcttgctctgttcatgtggctgccatcctccaccaaactcgaacctctttgacgaagtggacgttaggcagttcaactttgtatccccagcacctgccaccatgctcctgaaataagaggcagttgttacagttgcagtcatcctgtagcaatcgtgatctgctggtgataaccagccgtggtatatttggacaagacttcattctttttttttttttttttttgagacacagtcttgctctgtcgcccaagctggagtgcagtggcgtgatcttggctcacctcaagctccgcctcccaggttcatgccattctcctgcctcagcctcccgtagctgggactacaggcgcccgccaccatgcccagctaattttttgtatttttagtggagacggggtttcaccgtgttagctaggatggtctcgatctcctgacctcatgatccgcccacccaagcctcccaaagtgctgggattacaggcgtgagccactgcacccggccaagacttcagtcttctctcagcaagtgcttatagtcagactgttgtcatttaggcactttgctgggtacagagataaataagacatgcgtccctccttatttcacatggaccagcccaccagcaggtaatgactctgcagagacggggcagtgtcagaggagcaggggtccccaaggcagcagcttgagagggatcccttcatcttctctccagataaccagttggcaaaattctaaagcatttttctaactgttatcttatctggacaacacgatcaaaaaatactatgataggatgttggaaaaagatttaaaagaagccaaagaacatattgctcaacattgagcttttaaaatagggtctttttccgtgtgtgtgtgtgttttaaaaaaatgttttctcttgtttctacaagttttagaccaattatttttggagcaggaagatactgagttttcagatggtcctgtagacccccttacctgctggttttttggtggaatcctgtttctacaaaaagaaaaccccatagatgtagacacactaaaaaggaaaaccctggagattgtttttaatcttagaatttgtggcacttgtactacggtttttctcgtaacaaagccgcttctcgttggaaatgtctatttatgtggttcatgttgcccatgtccacttggaggttatgcctgagtctcatggctcagggagaatatgactcagcatcttttggttgagggcagctttgacctcattgttttctggtgtggcacagggagcagcctggccacgtgcggggaacggcccatggcctgtccctgttcgagctggctgctgcgaaagtttcaagaggcgtattcgccaggagcactcggctgtgaatccagacacggaagacagtggttttaatagagtaaaccaaaatgtaggatttgctctctccgatattctggaaaatcccactgctttagggcatagacttttcctgaaaatagaaggctgtgttttttaatgaggtgctgagatctttgtaacaaaagtgggggagcaactgtgctcagagccctgagggcaggatgttccctctgagctgtggccggacttcccgccttcccaccaggctcaaggttcagcagccaccttggcctctgcctccccgtcccctcccttctttccccttctccccccacttcctcctcctccgtcctccccatttgtgcttcagggtcttgcatattctggtctccctgcctggaaagctgtgtgcccagctgcctacagggctgcttcctttcctctcctccttcagagcggagtccatttcccccaccccacccctgcctcctggttgtgttcctagcgcggaggctccctgaccagctcttgctcattcgaccgctccccaacccggcgcacggtgcggggctgccgtggaaggggcgttttccattcatccgactttatttgcagtgactccacagcttagcagttcgggttaactttgaactttattttttttctgtttcagagacttgatattctttaaatgtactttttaattaaatgcgacctagacagcttctccctcctcagcctcttctatgagtaaagaggttcatgtgggggaaattgactaggattaggcttcatttccctctgctgcgtgttctttattcctgtaactacaaagaggcgtcatctgaagtgtttgcctttctgcctctgaagctacctggcgcccgttggttgctgacttctgcagaaatcctcctttgactcagtgtcttcacctccagccacctaaaaccagcctgggaaacgttcagttgagaacactactgtaaagtctcaattaaggaagtgcttgagggaaggagtgttctagttaatttttgcttaacagagcacaaccagtgtttttgttaggaggaggcagcattatgtaaaagaaagattatcaactttggatgaagacattccatgatttaaagcttttctctatcacttgaaaccatgtgacttagggcctcaattttctcatctgtaaaagagggataacaatcgttatcttactgggttgtcactatattaaatgggcaacatgtgtaaatcatttaccaagatgttttgtggctgcatggcagcttggcaaaatagaattcctttctctacttttgttttcgttcttggaactgaggccttattcgttggtatatggcattttaaaaatgttttgttaatgtaggacgttgaagtagaaggtaatagtagcggtggctcttaattttagaatctttatgataaattaatcattgagtatttgatgagtgtttattatatctcagatatgcaaataatagaaataaagaggttgtttcattcttttaaaaatgcttagatattctttgcatcttctaaaaattgaacttggaaaaccttttggtagaaaagccatcatggcaggtaaaaaatgtcgaagtccatctgttgacctcttcttgcttacaaaaggagcaaaaaacccactcaaaagcagtaaaagaggaagagacgtaggtccacaatgacaaaaagaaagggagaggagccagtaccgatgaaggatgagaacaaacacccagaaagcaaatctcagagggaggcatcacaaccacctggggagagggcctgagcctgaggacacttggggcagacttggtcatggaggggctggttatgacagagagctattagctactagcatggagggggagccattgctagtttgtataaagaacagtctatgttgtaatcccagctactcaggaggctgaggcaggagaatcacttgagcttcggaggcagagtttgcagtgagctgagattgtgccactgcactccagcctgggtgacaaagtgagactctgtctcaaaaacaaacaacaaaaacagtctacttgtaacccctcaaactgtaagcagaatacttaagctagattaaaaaggtagatgaacagacaaacagaaagttatagataatgaacagccccagagaaaagacatccacactctgggatttagcgtcccttcggaataatagtgagtgtttcactttattaaagtgaagtcgtcagttgacatctcctggttcattcatatgtataaaaggacacagggatcatttgaagaaagcccttcctgtaaaaggtatatcaaattaacaaagagggagaaaaaagatcccagaggaacacaaaacagaacttcagaaagtatttatactctccgagacatttagaaatgtatttcacccatgaaacaagaacaggatgcaatgaaaaatgaacagaggacaaaaagttagtcttgggagtcacaatatggttactgaaaataaacatccaaaagaccagttagaagataaagttgagggccgggcttggtggctcacgcctgtaatcccagcacttcgggaggccaaggcaggcggatcacaaacgaggtcaggagatcgagaccatcctggctaacatggtgaaaccctgtctctactaaaaatacaaaaaataagccaggcgtgatggcaggagcccgtaatcccagctacccaggaggctgaggcaggagaatggtgtgaacctggggagcggagcttgcagtgacctgagatcgtgccactgcactccagcctgggcaacagagcaagactctgtctgtaaaaaaaaaaaaaaaaaaaaaaaaaaaaaaaaaagataaagtttgaggtgctctttccaaaattaaaaaaaggaaaatattggaaaaaagtaagaagcatgttgaatcaatccagagtcctaaaatccaaccaataagagccctagaaagaaaaacacagaaaacagaggggagaaaattatgaaggaactaacgctatcaggtatgcatgtctagagtgaaaggacctttcagttacctagcacaatgtataaacccccctacacttagacacgttttattttatttatttttttgagacagggtcttgctctgttgcccaggctggagtgcagtggtgtgatcatagctcactgcagcctcaacctcctgggctcaagtgatcctcctgcctcagcctcccaagtagatgggaccacaggcacagaccactaaacctggctaataaaaaaattatttttgtagacatggggtttcactatgttgcccaggctggtctcaaactcctgaattgaagtgatcctcccacctcagcgtcctgagtagctgggactacatgtgtgtgccaccacacctgctaattttttttttttcttggatagagacagggttttgccatattgcctaggctcatctcaaactcttgggctcaagagagccactcaccttggcctcccaaagttctgggattacagatgtaagccactaagcctggccaaaaatcattttttacctcattcaagaactttgaagacttactttttttaagttatttaaggatactctagctaagtgaggacatatgccaagaataaggagacagtgaggtccagggaacggcaggtgttacccaagaatgcagcggaggagagtctcagagtgacgagtccacaccaaacaggaaagggaatgtctctgtgtttaaagggagctgggtagattgccttcatgtgggtaaaagagaacagtacaaaaggctataaacagaatgcagccatttttgccactcacaccagaggcgtgcttttctctatttagccctttgtgctaatatttaactccgtgtcttaacaatatgtgtctattgctagttcttgatttgccaattttagacgttacctattgaccttctgctgtgatggatgagctttttacctcatgcctcttcacacatccttctcaaaatatagtccaaacagtatgtgtaggccttttgttatttaccattgtaactctaagatatatacatgagcatgcatgcatgcacacacacacacacgcttctttatttcttgtaaactggaaacagtagcttttcactccctgttgtgtaatgagaagccaccctcacccccaattctcttctgctcttccacctcactccgtcttctgcagtttcatatcgtccaggttaaaaacatttaaattctgtttcctaggcacaattacatctggcattttagactatggattaattctaaagttgaaataaatatacactgtttatatttactatgtaaagattatctactgcacagctagacagtatagagagattatatttctttcttctacagatttttttcaccgggatttctaattgcctttccttttaaaaagaagtatttgcttgtgtgtgtgtgtgtgtgtgtgtgtgtgtgtgtgtgtgtatttttttgtaaacatggggtttcactatgtatatcttttaaaaatacatatatatctatatgtgtatctatatctgttgcttaaaaatatctgtatctatatatctttttaaaatatacacatatatatttatatatatttaaattacacaggtaaataacagaagaagtaaaaatcctgtttgaaagtatcatgaagtggtgtgagctaaaagctcatctgttgtagcagaaagtcaatagataatgtctaaaattggctaaaaacaagacatagcaatagatgcctataatttaaagacatggagctcaaaactaagataaaacactaacagatttaggggagattgccttagggagagggggtatggttttgtttcattttaagcctctctgtaatgttctttttaatttatgtgcacatatgaatttgattgaaatttaaaacaattttttaaaggaagaaaatataccaggatcatgtactacaatgagcactatccttgctattgaaatatctggattcaggtcacgtaatattctactgaaatgtttttgtgcagtctcaacagaaaatgcatagctttgccatcagaagacctatataaccttgaccttgttgtggtggtttccataagtcagattcaccttgcaggtgaccttgtgtgtgtatcaccattgcttttttttttttttttttttttttgagacggagtctcgctctgtcacccaggctggactgcagtgatgccatctcggctcactgcaacctccacctctcgggttccagcgattctcctgcctcagtctcccgagtagctgggactacaagcatgtgccaccacacccagctaatttgtttttttgtatttttagtagagatggggtttcaccgtgttagccaggatggtctcgatctcctgacctcgtgatccacccgtctcggcctcccaaagtgctgggatgacaggcgtgagccaccgcgcccggccaccactgttcttttaaggctgtaggtgaatcaacacgaaggagggcttcctcctcctgtggtggagctgaaccccgtgatggatggatgtgtgcggtgcctgcggcacttggccctgcggggctgcgaactcagccttggggctcatctgtccacagcacagccccttggagtctgccaggagctgagcccccaccagtctggggaggagggactcagtggcccaaggaccattctcctcaggcgtcctccccagtcctgaactcaggcttcctcatctgccaccgtggctgagcagtgattaatgccaaattagcaccctgttcaatgacctttcagcattagccactgcctcccttcacttcacataactatttgcaaatattagcttctccggccgtttctcctcatcagccactttcacagatgacaggcaggccgttagtctgattggcattccattcctgtcctttgccccatcgtgagtgcatccggactctgccatcttctcagaaatctgataaccagcccaggaatgttggcaattttacaaagcgaaggcgtcagcaggaaggtttccggagaagcttcgagggtccgctgcagagttggagagtctagagatggggaaggctgcctcagccccccagggacccagggctgggtgagagtcaccctcacattattcaatcaacatatagattttaaaacattcattacttggctctgtctgcatcaggcttctgtttttcttttagaattcacatgcacgtttaatacaaaaatctcatactgcttaggcagtgcaaggcagagcacagagctgtgggaaatcagagctgatgagaagcccgtcgtctctttcccgttgttctctctccgcggccctcaccccaccgccagccgggcaggctagaacctttcagttgccagaatcctccgctgccgctcacgatggtggcgagtcccttcagcgtgaagcccagatgaagcgttttgcgtttgcagtcatttccatttatttttatttccagcctcttacatctccgccctttattgaaatccctgttctagaaatgttggattggtcttcattttctctaaataaacagtagtaaagtgtactgtgggtagtttaattttgatgttaaatgtattttagagaaaagcggcaaaaaatatgtcctatttttttctcccttgtcaccagaagtacgagataaattatttatagtttgatactcaaaaaacatagattcaggatatttacttttcagaaaggaaaaaaggattgaaactgcagtaacagaactgaaccctttgttaattgaatatattggctccagggaagcatatttggacaggagtaagaatgcccactgctttccagtgacacccatgcctaacgtagtggctgatacatgaaatatttgtggaattgaacagatttggaaatagcaggtagactaggtaactcagtaagcaaactcttaaatcaataaaagaaaaataaagccagcaagcattttggaaaatgccaaacagtttaaataaagcccctcagccacacaacacacagagcagtagcgtaaggcccggtaaccatgcccggtaggacaggctgtggattgtgcctgaggacactggctgtgcttggaccccatctcatgtggtctgagaaaggccagggacagtgaccctgccccagggcttctcatgggagttcaggtaggggccatgaaatttgggtttcctattagcgtgactctgacaatagtcttcatttgtcatgctccgatcatcccatcttctatctgccctttcactttctgtggtttccattaccctccgtcaaccatggtccgaaaataggagagtacagcacagtaagatattttgagagatagagagggaccacattcgcataactttcattacattatgttatcattgttctgtttcattattagttgtagtcagtctcttagtgtgcctgatttacacatttatgacaggtgtgtatgcagagggagaaagtttgaacagatgcccttccactcacaatggggttatgttccaataaacccaccggaagttgaaaatatcggaagtcaaaacgcgcttttgtagccccgttgtaagttgaggactggactgaatgtgtatggcttttgcaccatcataaagttgaaaagccctgcgtggagccatcatacatcagggacaatttgtgtctgtagggattggtactctctttggttttaggtatccccgggggtcttggaacgtgtcccctcagataacggcggggggtgctcctgtacttagagtttcatggacatttctcttttctctgccacaggagatgttggcacacctgaaaccatggccccaaccattgtggttcccccgggcaacagaagtgtggtggctggatccagtgagaccaccttggaatgtatagccagtgccaggtacgaggcgcgtctcctgtgagactcctagtaaatattccatgacctgtgacgagccgacgatagaaggatacactggagcatgaggttcagccttctagcgacagtggtcttgtttggccgggtgggccatgaatacgagatatgggtagataaggaaatggacacactgatgtcttccagagtcccccactgcaacagggcggtgctttcaatgcagctctgggtggtagtggggggctcctctgagatcctctctagggaagagagaggagttgaggcagaggaaaaagttcattgctcttctcctcttagtcagccaaggtgttctctgcctacttagcggtcgctccagaatcaagctcggatgatcccgccttccatgtcgttgtgtcccctcacagtatttattttaaacattcatttcctgagcaaatgggatcattagcacttatggtccattgctgcggcaattagatatccttgcttaatagcccttgagcagaatgcatcgtcaatgcgtgctgggagggagtagagttacatctagattgagttttcagtgtccgttgttcaacccaccatgcaccctggtagcattagcttcgtcaagcctgtgccgagtgcctgagatgatgaccgttgccacctccctgagtcacaatcgtcgtcatgaatgcctttcattcccacaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtaatgcgggagcctctaagtggtgttgccagcatctcagatagcatccgacactgactcttctgcagaaacaaaatagcgtatttcagtggctttatttgtaactcggcaaatgaaggtgaggttgagtttaccttcgaaatccttcctagccttctttcccaagaatataagtccattaaatccaaagtgttgatgttctcaatccttccaagaaacgtccttctgaatactccagtcacaaagctcgggaaatagagcggtgaaacccctgtcatatagatccctctcctattctagctttaggctgctaagcttttctgtaactcttatttggctatcgtgatcggtgttcagaaactattctattattgctgtccaggcatggtggcttatgcctgtaatcccagcactttgggaggccaaggtgggcggatcacttgaggccaggagttcgagaccagcctggccaacatggtgaaatcccgcccgtctctactaaaaatacaaacatcagctgggcgcagtggcgggcgcctatgatcccagccactcgggaggcggaggcacgagaatcacttgaacccaggaggcagaggttgcagtgagccaagatcgcatcattgcaacccaatctgggccacaggagcaaaactccaactcaaaaaaaaaattattaatttagaaattattctattaattattaatttagctgttattttttgacctagcagaaaatgtaaaactatcggatgttaccttttgttaaacttaaaaaaaaaaagagaacagagatgcttcctcaaactgggcgacatattattcctgaaccaaggagaaagaacataaaattaagtacactggagttgcccagctctaaatgctggaaactattagtgtttagggagtgtgcattgtacagtggctaagaaaatacaaaacctattatcagtttatgaggaggttaagttgtgaggcaagtgactttatttctctcatttttccagctactgtcatgcatttattcttcataagtggccgtgatgactatgagagcagcctgtgttccgcagtggtagccgctgttgataagaggtagccttagaggccgcctctaggaaggagaatctcgacttcctctctcctctttgggaaaaaggggaattgagaacaggaaaattcaaataagaaaaccctcagagagccccttaaataaaaaaatttgcagtctgccactttgcaaaataaggaaaaaaaaaaaaaagcttgtgttttcctatgaaactagcaagaaaaggaatactgcacaaaaggtggtttaccttgatcacgtcccattcctttaatcattaggaaatgactccatgtcctgaccttgactcttctaaatacaatgcagtgcaaacctgtcggtccctctgaaagaagcgaaagtctgttaaaagcatccaaggaagccggctttgagtcaccaatcactgttgattctacatgagaggcctgagctggtattgctaccttccccatccatgcttccgctacagatgtaaatatcacatcccattctctgcaaagattttttcatcgaggttgatctgtagttctaggagcacagcacattatagattcagccaaaattaaaatttgcgacgtgtaaatctctagtagacaggactataccgtgttcaaacattttaaggtaatttaaacaagagaagaaatttatctccctttaaacgagaatgtttgtttcgatcatcattcctttttaaaatatttaaatctatcttaagagctttagttttacatttatatctgattagttttgtgttctctcgagttagcacctctccgtgttctgacttttaaaggtacacaaacacacttcacttctttatgatgttgagttaaatccccttttattcataagaatttgctgtagcaggtaggatttttgtggttggcgcacactgcaaaaaccctgaagagagtgtctgtgtcaattccgagggatttggatgagattataatcccacgccctgtggccgagcattattggtttcacagggctgtcaccatgtacctgtcaaaagggccacccgtaggagcacacaggccaaagacagagaaacaaatgggctcctattacttgtattttatactgatgacacaggacaggctagttgggctgtttgcccacctgcctgtctatgttgcttaatttctgtggcttgaatgagagcacagaggtcggcttccaggcaccaccccgccactggctgcccagtcctgtggagcagcccctctacgccctccaccctcccctcctgcctcccctctacaccctcctctcccgcatcacctctacactctacagcctcccctcctgcctcccctctacaccctcccctcccctcctgcctcccctctacaccctcccctcccctcctgcctcccctctacaccctcccctcctgcctcccctctacaccctccaccctcccctcctgcctcccctctacaccctcccctcccctcctgcctcccctctacgccctccaccctcccccctcccctcctgcttctcctctacaccctcctctcccctcccacctcccctttacaacctcccctcaacaccctcccttcccgcctcccctctatactctccgccctccgttcccacctcccctctacaccttcccctctggcctcccctctacaccctccgcttccgtcccacctcccttctacaccctctacactgcaccattcatgggcttgaatgagtgttggcctcagtttccacatccataaaatggagatggatgtagatggtaccagctcatattgtgaaggttaaatgcaaaaatgtctgtcacagaggctctgaaatagtggctttagttgctgttggcataactctattatcctatatgtcccattgcactcgctatttaccaataatcagttatgtgacacacatttttcatgtttagtgtctctggaatcaggatgtgcctcaccacctatgaaaccattttttttttccttggggtaagacaaggatgccccttacctctgactgcagcaccttagtgcctgtgagatgcatcttccctccgagccacgccttctccacggtctcctcatcacacacgaagccagctgctcccacatgtgccctgctcctgctgagcacgatggctcggaaactcggacggcgagttttcactgggatggactctttacctggtggggcatctgctgccagccccttcaagttgttcatggaattcagtgcttgtggcttgggggctggctcctggccaggggtcccctcaggttccagagtcccctgcatccctggctcatctccagagccagcagctgcggctgagttcttgtcacacatggaagctctctgctgtcccctgtgcctccagctgcagaaagtcctctccttttaggggctcacatgattaaattgggcccacccagcgaatccaagagagtctccctattttaaggtgggatacctaatcccacctgcagagtccctcttgccaagtgagacagcatattcatagattccagaggtgtgggtgtggacacctccgggagccgttctgtccacctcggtggactagcgtgcagtgcaggccagccgagggcatgcgtgggacatgctgctccctgagaggggcgacctggaaggaacagggaggcagcgcaggaaacatctttggatcttgcagtgatccctacacagaagaagctttgcaactcagaagccaaatcccagcagcattggggatgggagagcaggaaaaatgcatggtgttgttggggggtccttctccactgcggttgcctccattgggcctgagcctgcactttgtcacactggcattttggagagtgaggtcatttgacagaggcccttggtttgggggcagtctgggaggtctccccacctcctctcctgagactggggagctagaagcttgcgctgcccctggaggcagctgccatgggctctgggccatgtggaaggcggaaaatctgagctggccttttcctaacaccctgacttcacacagggcatgagaacctttccctgatgtcttcatattgtttcaaaagagggagaagtgtttgtttccatcccctgttttgttggctgcagtcaggatcaattttcagaagtccagggtggacccatgttggcagagtaccctttctagacacagttgccactgacaggctaagacatgccctcgccctcttgccctctgaagagtaagtggttgagagtctatgcacaggatgactcatttacaatgggttttccccagtgtttaactcacgggcttttcacggtccataggcttggcatttcctccggttctttgccttagagcagactgtgtgtaaaaccgtagctggaaatggggagaaactccatctgagcagccgctgggttagaatactaggaagggttggcagggagagaactcgtaccctcacacggtggggaagtactaagggaagctcagaggccacgcagggcatgggcagctctgcacctgctccccaggcacagcgacctggaaggctttccagaacaagctaagagcatccacaatgaacagccagatgttttccacccatgcctagcactgagctactaaaactgcccaggacattggcccctgcaggcggtggcaggctgccccccagaccttgcccatgccacagtactatggagagtgtggagtgggatgagttttctcaccaggtggcatgctgtgtgccaaacacagatggtccctggctagggtggagagaggtcaccacttggagaggagcagcatcgtctgggcctggaggtccccagagccatgcacttgctcagccaagccagcttcgggtcactgtgtggagtgcccgtctccctgaccccagcgaggtcccttcctggcactcgagggaagcctcgggggactgtaccaggcgacaacggtaatcagtacctcagggaaggcaccctgggcccgtaggtgccgaccattgttatctatggattttgtatcatcaaagcacaggtcatcttgggtgaatctcaagggaaccatgaagagtgaaaaaaatagttgcaaaagttacactcgatgacctcctttctgtaacgttcttgaaatgacaaacctacagaaacagagaacggattagtggttgtgaggggtgggggtttggggtgctcctggtcatggaaggcaacacccttgtgctgatggacacgtggacctacacacgtaataatgttgcatgggacgtgcatgtgccgtcttttcacgcacacttgagcgcaggaaacactggcaagagctggataaattaggttgattgtatcagtagcagtatcctgatcatgatgttatgctatcgttttttgcaagatgttaccattgcgggaagccgagtgaagggtccatgagctctttcagtgttacagtgttacttctcacaactgcacggactcgacagttttctaaaaagaaaacgctcaactaagaagaggaaaactataattaatcataagcaaatgttgttgtcgaatgtatgtttttttcctttttccttccatgcttttaatcagatcatgacggtagatattgacttagcttccctgatgaatacaggtcaggacctgcacacaagggccctgacagcaggcagctactgtatgtatagttggaatataaataatactgccttcatgattattgattgaggaaacgtgatcaaatgggggatgtatgagttgtgcaatgaagatgagcttgaaaaaggtagacattaaatgctggcaatatttcttcaggcttggtctgtacacatgaaaacttaagtagaggaatctgcttccttctaatgaatttgcagccatctcctcagccggagtggttgattcaggcagattctttctgcttgagtggtccaggtaatcgcagaagtgaaacatcactttgcctccttccagaaaccttcagccgcttcccccttaatcgtttctttgaaatgcttagttttcatttctctttttcatcttttaggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgcaattggctctccaaggaaattcattgtttaatacaaccactgtttttttttctgcggaacgggcgagtggagtatcgagagattgcaagtgcctaggagtttcctttgctactaaagatagatgagtgctcccttatatgttttctcttagttattatttggtattccattgaagtattaaatctctattttggagaagaactgctaagaattttaaaaatatgttaataggctgttgcccaatacaggctgcacaccttcctcgggcacttgacaagcttcacgagctcgtgtttagtttagatactgaagcaaactagcccataaaatacggtgctgtaaatataaacctttacgaacctcttggggtagtccttctaaaatgtaaattaagatattccatgattcaagcccataaactgaaaagtagccatcaccctgagtagtaagttgctttctgaaaccccagactgtaaattgcctttggcctgtgctcactgagttctgagtttgtatgcacgatgctaactaatgatgaaattttcaagaatggtttttaagaggagcccacactatcttaggttatatggtctctgacatatccttctttggcttaggggcttttttttattttcttgtttgaagagccaccatattttactgctgagcccgagagtcggatttcagctgaagtagaagaaactgtggacatcggatgtcaagccatgggtgagtgcagagtggctgctggacaaggagccatgactgggaggaagggaaacaacctttttccatagcagaattgccatcattctagggagacattgagtgtgatggcgaagagcagacttcagagagtagatcggtcttggggcagtgactgtgggtaaggcatttgactttgccaagcttttgcttcctcccctgcgaaacagagatgatactatttacccagcagagcaaaaaggaagcccacatctaccccagacagagaggggactccatcatatcctgtggactccccttccaaggccctgacttcacaagtgtgtgaccccccgagattcggggcagaaaattctttctcatccatggggtgactaggactggtgagcacagccactctagaaagggagatgggtgtacatgtatttgtagtaggtacgtgaggtacaaggcaattttgttccactgatgtattgcacagtggtgaagccaaagctgggagtgcgtccgtcactggagtgatgtaccctgtacccgttaagtaatttctcatcgcccaccccacacccttgtgagtccccattgtctgtccttccacactctgcatccatgtgcacatgtgacttagcacccacttattagtgagaacaggcagtctttgtctttctgtgtctgagttctctcacataactcagtggcctccggtgccatccaggttgctgcaaaagacacccttttattcttttttgtggccgaatagtatttgaataggaaatgttacctttttttttttgccttttcagctctgggtccccttttcctttgccattcaggtcatcccagccctcatccccatgcttcaattacaagctgcccactgtcaccgtctcatgtcgggcagcacaggtgattacacaaaaccttctagcagagacaggcttgtcaaggcagtttcgttaagaaaagctgtgtttgtattctggcaactatcaggaaacgaaaaggatcttttctcttttgtttatacccatccgtcctaaggatagtattttctcctactccctaagagctcggagggtaagaatgactaccagttttgcaaatcttcaaaacagctcctaaaagagagatgattttcactgtaccacaggaaaaccaagccctggaaagcatggttaagtacagtgccaaaggcactgggccactcaatgaaatgggatccttctctggtgaagtcattgcccagtgtgtggcctgtggaagttactcattaaatactgggtacctaacttacctaggtccacatggtaatggaggcaggacccaaacgcaaatctgtcagccaccaaagcagccacctggctcttgccagaacactagcttcccccaggacctgaagccctggacttagaacaaatgccatttgtccatacctgcaactgtgtggatgccatttcttattcctgaaaatggtgtgtcacccttccagtgctgtgccacccttccggtgcagcggcgtgtcacccttccagtcctggtggtagagggaaagatcagcctctgcccacagaccccctcccgacccaccgtgctttgtaaccactgctcctggcccgggacttggttcagtaggagttctggtcctcagctcctgaccagctcacagcggctgctgtccacggctctgttctgtttctgttcttctctgttccagctctactgattcggcataggggagggggaaaaagtgtgagagaagagtaagacgaattttacgtggaattatctttcttacagtggttgcattgttctttcttgtgtaggtgccagcttcttaaggccaacaactctgtgaatgtgaagctataaaatatttagcgagcttatatttcagaaataagagtatacaatactgcgggggataagatttctgttatgacattaaattgccccaaaatagaaatactcccagttccctatgtactaacaattatttttcaacaaatgacaatcttaaactccctttgacaagagaaagctctgtttttttgcacgacttctgcagggtaaactgcttgttaagtgtagacttacaaatatagagacaacagatcttccgacattgcactgctgtcatataatttactgctttcttttcattttgacagtgaaactatagcagcatgcgaagtggttattccttatgaaagtgacatcatgtaactgctattatgagatattacatgaattggttatgcttttaccttgaaatggattttttaatatttcctgacttaatgaaaagtgacaggaaacataattaaggcaaagaagagaatctaggaagacattatcttgagttattccatggcattaactttatttattaaagtcgacatctcacacctacccacacgccatcttaaatcaagggattttggtgtgctttgcactgaagcatgtcaagatatgttttttatttaaatccactttctctttagggaaactgaggtacagaaccatctgagatctagagctaagtgtagatatgcctcatggagcgaggcagcttttcctgtatccacaatggaatacctcttgtgcctcctcctcgacccttaacaaggttacttaacctaacaaattgctcctctgagacagtagaactccatgaaggcccatgatatccaacccctttgatagggggtgttaaaagatggcactcattttcattgttagctgttgggatgaatagtgatactgccattgagcactcaccaggtgccgggcatgagttttataaatacatatgtaaatgtacacacatgcacatatatgcaccacctcacacagacacacatagaaacacatgtacacatatatgcaggtgcacatatacatacacagatgtacacacacatatacacacacgcacatgtatacgcatacacacataaacacatgcacatatatgcacaaacacacacacatacacacatgtaaacacgtagacacatgcacatatatacacacatgtacacgtgcacacactcgcatgaacacatgcacatacatatacacacacatgcacagacacacaaacacatccaatcttcaaccttctgaagtcacaattatcactaacctgcatgtgaggaaacagacaaagaaagggacaggtaatgtattctgcccaaggtgacactgtccgcgaggcatggacctgggatgtggcctgtgtcctgtcctctgcccctatgaccctgtgcccaagccctcccgcggtggctgagtagggcactgcagagcagagagggcttcatctccatctgaaccttaacctgactctcagctggaatctcctttccaaacaagagcatgagcctgtgtgggttcggagtggagcctggaaggcaccgcagccagggcggccacagttcatgccagctgttcctctcaacacccctccgtgtcgatggcttcatctacaacgagaaaaatagctccttatagggtggttgaaagcacgaatacacaagaaaatgcctattaaaatattggcattctagcctttgaaacagatgtgcttcagttctcacgtcaggaattatttttaaaatcctatttattcccattcctacgcaggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccagtgagtacacccaggcccacagctacctgacctggacgtatccagtgagtacactcagccccatggctacctggatgtaaccagtgggtacacccaggctcacagctacctgacctggacgtatccagtgagtacactcagctccatggctacctggatgtaaccactgggtacacccaggctcacagctacctgacctggacgtatccagtgagtacactcagccccatggctacctggatgtaaccagtgggtacacccaggctcacagctacctgatctggacgtatccagtgagtacattcagccccatggctacctggatgtaatcagtgggtacacccaggctcacagctacctgacctggacgtatccagtgagtacattcagccccatggctacctggatgtaaccagtgggtacacccaggctcacagctacctgacctggacgtatccagtgagtacattcagccccatggctatctggatgtaaccagtgggtacacccaggctcacagctacctgacctggacgtatccagtgagtacactcagccccatggctacctggatgtaaccactgggtacacccaggcttacagctacctgacctggacgtatccagtgagtacactcagccccatggctacctggatgtaaccagtgggtacacccaggctcacagctacctgatctggacgtatccagtgagtacattcagccccatggctacctggatgtaatcagtgggtacacccaggctcacagctacctgacctggacgtatccagtgagtacattcagccccatggctacctggatgtaaccagtgggtacacccaggctcacagctacctgacctggacgtatccagtgagtacattcagccccatggctatctggatgtaaccagtgggtacacccaggctcacagctacctgacctggacgtatccagtgagcacacccaggccgacggctacccagatgtatccagtgggtacacctaagctcacggctacccggacatatccagtgggtacacccaggctcacagctacctgacctggacgtatccagtgagcacacccaggccgacggctacccagatgtatccagtgggtacacccacgcccacggctacccggatgtatccagtgggtacaccttggcccacagctacctggatgtatccagtgggtacacctatcagcaaagccagacctgctagactgggccttcaaggtagaacttcccaaaatttgctccatgtactacacacagaaaatggtagtatctgttcagccccctgaggtaaacagaaggggtaatgtggccagaagtgggcagaccaggagagccagctctcaagcacacctgaagcctttgtgggtcctgtggggaaactgctgaggcccacaagcagcacagacggctgtcactccccggccctagtaccctcctcttctcagggtagcgttgcctcttcccgcactaagccctcctctttcttgaggagaagtagaaaaaactcccttattttctgggcagaattggaaagactattgagtgaatagatcactcctaatctttttcttttgatctttttttcctattttttacattcattctctattttacttttattgaacaattgtagttcttttgtgagtttcttttattatcccattaacagaaataccttggctctctgtctttgaaaaataaactcaaggtaaaggttttcattgtttctgtgggttttctttttaatcttccatggttgtataatactgttcttctaaaatgaagtagaatctagtgattatggaattataccttttgtgtttgccctttcgggagcaaaatgctgatatcctcaggggtgagagctgttggagagagcaaatcagtgtcactgtgtgcacagccaagggctcttcccacccacagcctgcaaggagactgaccaggtgtgtagcaagctgtgcatgtgtttcggtgaactaggggtcccttccttgaatcttgccctcgggtcaaatttgtctttcattttggagcttaggaaaccaatattgcttcaagcagtagaaataatatggaatgctcaagtcagaacatgagtcttgattgattagaattatttgaagcctatcttgcaatcgtgagctgggacgttcttgagcagggattgacaagctttttctgcgaagggcctaatggtagatatttttggctttgaaggatgtggcctactcagcattgctgtagtaacctaagagcagccacagttctcagcacatgcgagtggctgtgttccaataaaactttatttacaaacacagggtgcaggctgaatttggcccccaggttgtagtttgccaatctccattccagtgagagacttaggaatgagaataaaaaagaacccagagaacatctctgggtttctctcagcctcagttttctcatccattaaaatggagctaaccaaacccagattataggattctcatgagggtcagattggaaatgtaagtgaaagtgccacctgcactgttaccacggcagtgagtgagtgaacaaacaaatcaatgattgtgattatgttatctgttttgtagtaggaggttttttgcaaaatgagttttttaattaaaatacccttaatgaaaggaaaatgtgctttaaaaaatcgatattgatttgctcatttagcaagcggctgctgagcatctgtgtcgggcactctggatgaggctctggggacacggctgtgaggaagacaggtgaggttcctgtgcttccaggacagagggtctgcagggaggagaaaggcagtgaaggacgagatgactccagccagccaggggtgctgcagaaaaggggagcaggtgcggtggcatattgagccggggcctcccccagacagtgtggctgccgggtggggcttctctaggagagatttagaaggagcaggagtgtgaactcttggggacatgcgcattgcatgggctggaggggacatcaggtgccttggaggagcaagctcggcatgtgtgcaggtgaagggaggcggataggttggggctcagtgacaagcagggtggccatgacgggctggagggtggagggataggcaggggcagaggccgagaacaggaggagcctcgggagctgcgagcaagcagagaagggacatgaaagcctttgtagctttcaaagggcagcccaaggctggctgcctcagggaccctgacacaggcacagaagtgttgagacctgttagggggcctgcggcatctggcaagacctggactcgggtggttgcctgcgaggtggagagacaaggtcagcttcaggaagggccttggcagtgaagtttctgggacttgccatggtccatgggattctcagcaggtgcaggcagaggcggcggctgtgccctgggtcccgtgaggtctactcacttctttccttgaggggtatcagcccagggaccctcacagaagacttgagagacacagatcactgttgtacggggggttccggttaatcgttattgggtagcacagagttaggcgagccctcgctgaagccatcaggagctcctcctgtctttcctcggtctgactcagggctgctcggggccgtgaccatcccccatgaacaagaagaaacccagcacttggggatcatgacacctcccagaaatgtatctttatggaggtctttgaaacctggttattttaactctcagaacagatcctagaaagcatcctagaaagtgtcatcttgtggatgacattttgtattcaataattagcttttttttttgtttttgtttttgagataaggtctcactctgtcacccaggctgtagtacagtggcacgatcatcactcactgcagcctcagcctcctgggctcaagcgatcctcctgcctccacctcccaagtacgtgggactataggcctgcaccaccatgcctggctaatttttcatttttggtagagacagggatctcactgtgttgcccaggctggtctcaaactcctgaactcaagcagtcctcttgcctcagcctcctgaagtgctgggaatataggcatgggctacctttcatttaaagaacaaaagcagtcttttggctgatctaaataaatgcctctcctctctttaatattcatcaaaaactgttcttcctgggcccctgcacgtttccacttgtgtatctattacatcgtgacgctgtattttctctccaggttgtaaacaaagatcggtaactcctgggagaggaacagtggagggctgccgtccctcctgaacagtattccttttgtattgctacagttacctctgtgattggctctctaaagcccgtgcaggatactctgccaggctgatgtgagcctctcaggaacaaggccctgatcatttcatttactcctcttctcagatatcgctccagtgttcacccagcggccagtggacaccacagttactgacgggatgacagccattctaaggtgtgaggtgtccggggctcccaaacccgccatcacctggaaaagaggtgggtagcatccactgcccacaacagcatggcccatgtagaacataacctatcgggccagtgcttgcttcttattcactctcttgtttattcacttatgcattcactcaatgaagattaaataactcttattgcagcagtccccaacctttttggcaccagggacctgtttcttggaagagaatttctccatggtctccagtgggggctgatggtctaaggatgaaactgttccatctcagatcattagattcttctagggagtgtgcagcctagatccttggcatgcatagttcactggagggtgtgcgttcctatgagaatctaatgctgctgccgagctgacaggagggggagctcaggcagtcatgcacggtggccaccgctcacctcctgctacgcagcccagttccaaacaggtctgcagcccagggcttggggacccctgatttacagaatgcctaccaggtgcaagataccatgggcacaaggataaataggacagacaagatccctgccttctagaaagggaaacacacattagaaaaagagaaggattgtgcaaatgtcactcttctctatccacgcccttcagagagtgcctcaggcctcctcgggccttaccgtgtcaaggactggatgtgaagtcactctgctagcactcacttttcccactgttaagtggagctcttccttgtgacattcagaattaaggatcacggcctttgttttgttgaagaaagatgcttccagggccacatcgttccgtgccttctgcagtcaacctgggacgcttcagcccactgtgggttcagttcctgggaaggctgcctttgcagttcccatagcccgttccatgagggccactgaaggaacagcacacagagtccatcctgaacaagtctgtgcttagccttgttgattcacatggatgagctcctcatacttgctgggctgtatcgggctgacatgccaaaagccttatctttctcttccttctggaaaaccacctggcagcttctcgactctcagaggtacaacccctgcactcagacacagctcctaaagatctgggacactacagatcaataacagggctgggcttttattctctcttgttttcctgcctaattttgaacataatagctttatataaaaatgtttcaaatacatgcagatataaagaaaactaaaaaccgatcacccaaacatagcaatcacgttcatggatcataatttgtttaaccaaatctctaaatattgagcaagtaggatgttcttggtttttgttattctaaacagtgctagcaggtactgcttcagttatttcttttcctacaattttcactttattctgattatttccttaagttatttctttgttgtattagtccactctcacactgatataaacacatacctgagactgggcaatttacaaagaaaagaggttgaattgactcacagttctgcatagctggggaggcctcaggaaatcatggtggaaggtgaagaggaagcaggcgcatctcacaaggctgcaagagagagaaagagcaaagggggaagtgccaaacagttttaaaccatcagatctcatgagaactccctcactatcaggagaacatcacgggggaaccaccctcaggatccagtcacctcccaccagattcctcccccgacgtggggattgcaattcgagacgagacttgggtggggacacggagccgaaccatattacttgcttatggctctaaccactatcttcatttccttcaagcgttacgactgtaacatgcctcttttctccactgttctttagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggagtaaggagcagccctcgcacgtcggccttctgttagccacggtttaatcatcacgtcatcgtgtgctttggggatgtcagcatgcccttgggcttgctaatttaatcaaaagagaatgattatttttacaactaatttatagaaatctgttgagaaattaaattttcaatgtctaaaagaatacctagaaaatgtattcagagatttaataggggcattgcaggagagacgaaagattgactttgtaaagtcagtggagatattacacaaaactagctcaaatcacaaaattgataggttggttaattttataagcattttataagaaaattaagaattaaaatcctaaagaagtaatattttgctaaacatttgttagggacaactaaaacacttctaatacactaaccatcaatgtttcttgtatgttaggagtgaactgaaagaaaatcttccgcttttgctaaacaattgttaggaacaactaagacacttctaatatactaactatcaatgtttcttgtatattaggagtgaactgaaagaaaatcttcagcttttgcactttttaaaatcaagacacattttggaaatgcagagtagttttctggagcttaaggattggaccaaatggtcccccattgccactttttaacttcaattgccaatacactttctcctctctgtctcatctcaatctgtactactaaaaactcatattcaaaaagcaaaagaatgctcactcagatttttacaaatctatctacatgaggagagaaagttttaacttgcttgagggagtaatttgttgaaacgttattcttccagaaaaagtaaatcattgtgcttcatttcatatttgtctagcattttctatcatatggttggtgtccactttgataaacgactcttcctaatttgtaaaatgatcatgcgtttaaaggaaattaatccaagttcccactattctgtcaagtactaaaaagcagcttttgttccatttggtggatgactctgtcagccacttcgttcattctgtatccctaaatagtaaccatacatttaacccatttatgcctgaggttgcagttttttgaacttttgtaatcagaacttggcgatgaccttgagcagtaggatattaaaaagcttatgaaaaagtggtatctgaatctctgtagatcattcgccagaaaattttgtggatctgctgagattcaacattatagcgacactagcctgactgggataacgctttggtggctttacagaacattttcacacactctgcccactttaacctgtacaactattagtgacgtaagcattccctgccatagccaggaaaactaagatgcagaattgtttttctggactcaccattagcagaggtcaggcttgccctcgaacttagccttgtgactccgaagttctgggctctgttcctggaagcagagcaggtcccccttagaggtatgggtgctacagtgacccatcgcacaggcaagctgggggtccccatcccgtactggcttgggggaggtgggcaagtcactgcatctctgagcgtccatcttccttcctgaaaactgagaatagtaatatttagccctcacaagagtgtcttgaggaataaacacaactcaaacaaaaacacttgacagactcaaaaagtaccatgcagacgctagaaatgactagaatgatggtcatctagggagagaatctaggttttattttagagcctagaacctcatccacacctgcatggggtggtcggcattcagttacttccatggtgtttgaggttaaagctgatttaggaggggtgggtgggttgacagactgctgcaatggtttacttatttgcttgtttttaactcccctagcatttctgagagtgatccatttacactcattctgccaagatgagagaaaactcggaggttgtgatgtcagatgaccagggcattatcccccctgagggcagaaactgtcaaacttgtcatttcgtctgactcgtgacttgtgtttttttcagatcggacgtccatcgtccaccctcctgaggaccacgtggtgattaaggggaccacggccacgctgcactgtggtgccacacatgacccccgggtttcactccggtcagcacaatcagttacaatgctttggggcttgttgatattctgtgagtttctgaagtgaagttgagatgaggaggaagaattgggggaacttttgatttcagcagcaggtccctgattacggtatcttctggttgtgggcaccgtcattaatcatgcaaatcccattttccactccagccttatgtgttatttacagtgagctatgttccacttcatgacgttaatgctgcttttcatgatttttcctgccaaggttaatacactatctgtaaaacgtacttgtcagaggctgatactcaatgagagaaaaatccagggggatcgactaggattcagcattgtttacacgggggctgtgccactcccgggagagttctttactctcgggatagtttcatcgtgaaatggagggggagggagtcctgtgcatgggacaaagtcacccacagcccccagtgcactaataggaaggtgcatgccaagagggaggccagatgtgagggttctcttttttttttttttttttgagacagagccttgctctgtcacctgagctggagtacagtggcattatctcagctcactgcaagctccacctcccgggttcacaccattgtcctgcctcagcctcccgagtagctgggactacaagtgcctgccaccactcccggctatttttttgtatttttagtagagacggcgtttcaccatgttagccaggatggtctcgatgtcttgacctcgtgatccacctgtctcggcctcccaaagtgctgggattccaggagtgagctgccgtgcccggccaagggttctctaaaggaatgccgacatcctgtctttgtttaaattcgggccaggaaagtaactgcaaaatatgagactccaggtgaagttgtggtggcagacaggtgggcatcagtggggagctgttccctgaagagcagccaccttcaggataattttaaatttttggaatcagccttgaaaataaaaaaggaaatatccagtcatcagagtatttccactctggccttagcccagaaggggcacagtgcatgagtcgaatgggcagactactcaagatgccctgctgctttctggggcctctcaccccgagcagaggggacagctgtgggtgcacagtcagcagcgggacgcggagactcggctgttctctcgcgcttcttgagcgggtgtttggccaattgtaaatttccatgtcgccacccgactccctggggtttcccagggctcagaatccaaatttggtttaggtacgtgggtgccgaatgcaaaacaaaacaagcaaaacaaaaaccagcaagtgaaagacgacctaggacccccctgggggccaccctggagacggtcgtcaggcctcggaaagagctccttcctaaatgatttggagtatgacttcaaggaagtctgcttttctgctactctgacagctcagaaagaaccccctcggatccctgtggtttcgtagtagcttgttatatgtgattaaattggaggccccttcctcagatggaactgggttactcgctctcggggtgcccctcgtcccagggttgctctgccctgaggagcgccaggctgtaagtgaccagccagccagatgcgatgccccggcgtgagcagtctatccatctccctcttgtggaatcagccctgttctatctcagggtaattgctgagaaggtagtttgtaaatgtctgtgcttatgactatgaagtctttaaagaactgggcacatttgcaaaacccgatcaaattattgtggaaaagaaaaacagcactttcattccatatagcaatgagtgctggccctgcccgtggtcatctaaagactgggcaggctctcaattgattgtgtatttgaaaagaaaaatgtgctcaaattgctacagatagattaaatgagaaataaatgcaattttaaggaccatctgccagaatggtcacattttaagaaagtgtgtttttgaagggtgattttttttttcatgagttgggcaattccactctgtagattttttttaaacagtcgttgcctcctgtccagacaacactcttgtcctccaggagcatttaccggggcaggaatgttgggtgcagttttcataggtgacaggtatgcccgtggttctacagacttctcatctctaaaacacaaggtcagacaggcagggccagtcattttcattgccctgtttgtaacctcagcatgtgtttttgtattatgaccaagatttctggttgcttttcttttttttattattttttggtttaattcatatgccataaaattcactcttttaggccaagtgcggtgactcaggcctgtaatcccagcagtttgggaggccgagacgggcagatcacttgaggctaggagtttgagactagcctgggccacatggcaaaacctcatctctattaaaaatacaaaaaaattagccaagcatggtggcatacatctgtggtcccagctactcaggaggctgaggcacaagaattgcttgaacccaggaggtggaggctgcagtgggccaagatcatgccactgcactccagcctgggccacacagcaagactctgtctcaaaaaaaaaaaaaaaaagaaagaaagaaaaagaaaagaaaaatcactcttttaaagagcacagttcagtggtttttaaagtccattcacaagattgttagttgcttgctttttaagagacagggaaggagcagtgattctgtcactgtggggtttgtaactcaagaccctttgcttggcccacagctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgatgtgagtactgagacgtttggtgttagccagtccgcggttttctccgttactgtgcccctgttagtgactgccacttcacaagtgtcacgcccggcttgtgtcccaagtcagcggtcagaggccagcgcatcatgctgcataactacatatatggacaaggtttttttgtggtttctttcaacttcggaattgagaagtttcgtttttggtgtagatggtgtgatcattggtttttatttcagttgatcctttttgtcatatttttcccgtggacaccttatcctgataggccctgtttaccactctgcgcttaagtagcaagttcatttttccacataatacccttgagagcctccagtccatgagagatgctggagtgggactgctgaggcgaggtcgttcccgtgaaagccacctagacttggggtttcagtgagtcccagctgcccctccgtgggtaaatagatactttaagttaagtcttgtgaaatcttgaaaacagaaagcaactgcccgttacttccaatctggaccttcctgggggttccaaagagcccaggcgggaaaccgtcaatctcccccgtctctgctctctttctccctccactcccctctctattcatggagcaggaaaccaaaatacctgctgacacattttatttttctgacatgtatttatttgctttttaaaagttgtgccatctcaatattccgtgagtgcatgagtacaaaaataaaacctgaaaataaagaatcccaaccgagcactcatcaaggcagtggccagctccagggacacacccagcgcatccgtccctggtcatcgtttgacatgctgggcctttcgacaaaggcaatcttgagagatttttcctcactggaccctgccccctttgatccaggaaagattctgtattcaaaatcattccccacaaatagaatttgaacactccgagtataggagccgtgactcattgatccctgaatcccaagactccagctgaggggattaaaaatgaaaagaatgcttgctaagtgctaagcatgtggcttctgtgtctgccacacgcatgtggaaatgagtgaactcacaaacagctttcctgtagtccctatttgtggatataaaaggttcacgatgtgtagcagtcagtccggaaggccctgtggtgtcatcagtacctgaaaaacatcccatcccaactcctgttctgtctccttccaggatgaccccttgttctctttagatagcagaggtaattgtggttagttaggaagcggcaggagtccccatggctctacagaatcagccggcggcagtggtgcgggggtcctggtgctgcagctgcaaagctgccacgtagagggtcctccagagaatcactgagggtcccggggctgaggctgccacgcagagggtcctccagagaatcactgagggtcccggggctgaggctgccacgcagaggatcctccagagaatcactgggggtcccggggctgaggctgccacgtagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgtagagggtcctccagagaatcactgagggtcccggggctgaggctgccacgcagaggatcctccagagaatcactgggggtcccggggctgaggctgccacgcagagggtcctccagagaatcactgagggtcccggggctgaggctgccacgtagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgggggtcccggggctgaggctgcgaggctgccacgcagagggtcctccagagaatcactgagggtcccggggctgaggctgcgaggctgccacacagacggtcctccagagaatcactgggggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggccctccagagaatcactgagggtcccggggctgaggctgcgaggctgccacacagacggtcctccagagaatcactgggggtcccggggctgaggctgccacgcagagggtcctccagagaatcactgagggtcccggggctgaggctgccacgcagagggtcctccagagaatcactgggggtcccggggctgaggctgcgaggctgccacgcagagggtcctccagagaatcactgagggtcccggggctgaggctgcgaggctgccacacagacggtcctccagagaatcactgagggtcccggggctgaggctgccacgcagagggtcctccagagaatcactgagggtcccggggctgaggctgccacacagacggtcctccagagaatcactgggggtcccggggctgaggctgccacacagagggtcctccagcttttgtgtacgcatggggcagccaggtttcccccagcccctgccttcaggcattggagcctacgaccctgggttctttctgcccttcatgagccccagccatccactgtctctgcggttgggtgctgtcatccgtgggcttccccggaggtctcctgatcatgcaccccttagcattcaacgacagtagcacttcctgcggttcagttaccaggatgctgcctgcagttcttccctgcgcgcagctgatcctcctggtagcactgatcacgctgcagaggacgaccatatcttcatggctccctctcctcctggaacagaagcaccttggtggcactgttttgaattttgagtgcctgatgtagtatttgttgtataaccgttgttcaataaatatatgttggttggttgctgcctgcgtgcatgcatgaaggaatgaatgaatgtgtgtctgccttggtggcccattggcgggcctccttctgttccctactcgtaccttgatgctcacatgccctggtttccccaccatgggtatacaagtaagctcaggtcgttctaccaaaacccaaacagtgagtacccaaagccctcatccagccctgctcctgcctctttcctccttcctttcgggtctcagacagaggattttttttttttcattttgataatataggaggatatggccagtgagttcctaggagctgttgtattatgcacatttttaaagctacctttgagaaccttagatcatccatcgttggtatcaaataaataagcgttagcagttcataaagactctgtcagcagaagccaaattgcatacttccaatatagcccattctttttattctgcacagttttatggtctactgatttacatgtcttccctactatttgcttatttgatttcctctaagtaaaatacatttttcagcaaatgttgctgtatgtataaaataataggctttctctaacggtaaaacatctcatctctaaatatagaaatctctgcaaatttgtgattcaaactaatttaagtacaaactggttacagaactgatttggaagacagttgttcctcgtgaattgttagtgtcacgaaggctcctctatcccaaacctggatgaattgggaaaggtgttccttcatggggtgtctttagatccaacagagcttgactctacaacaataatggcaatagaatgataataataataacccgtgattgcagggcattctgtccttcttgggtaactttcaaactgagctctgtagtgtttccatcatttactcagataaccaaaaaaaaagcaagagaaaaatctcatattgccaaagggaagggactgagaggtgcttatgactaaacaatgtccttcagaggagcctgaaagcctgttttctccttgcctctccacttcagttaaaagctgcttcattaaatatagaaattacgagcatctgaagtgagcttttcaaaaatagaccagccgttggcctcttctcacgtctgtttgccccgagttttacacttagcactaagcttcacctcattgaggctgagtggaggggcggcccccacacccacatcacacccacagcagtcctgatggggctgctggacagcagtggggccaataggagcaaagggctgcacaggaggccctgctcacctttcactacttgtgtgactttggacaaatcccctcacttctcagcttctgcctctcaccttgtagactgggcatggtatcattcatctcaaaggacggctgtgagggcggcacccacccgggtttgtaagatcctgttgtggaagccagttggggagggatgctctaagtcctagctcttcgtgctttcttaccatcttatactagaatgctgttcccccctttcctaacagcaccctgcctcctggggctgggaactttctagccctttaccctgcattattctgactacattctatgaccttctgacactagactcgagatgtgtctgtttgctgttgagccctcaatgcctggaccagtgccaggtatacagtaggaacctaataaatgtctgggtaagcctcactccacctactgagctgaaatgagacggtgtcttttgccctactgaggaggaccaatttaggagggctctgccttcatccccccactgagagaagaggcttctaaactccagatggttccatgaggcagcctgtaaattaacaagacaagtcatcattaaatgctggtcaccccttgttttagtagcgtctttgctctagttttctagtgccatggggacaggagccagtttccaggatgacttcatattccccaaagcatcttcctgtattgagcacaccagagggaccaggctcctaaggccttatggattgattaattgttaaatcatttaaagacccaattagcatttcatctctcctcctgaaatcagagtctaattctcatgggcctggagtacagagaaaacccaatttacagagctgacttggagaccctgaggcattgggagaggtttctttctataaaaccagttctgacagagccctcgtaaggagtgaagaatttaatactgtttcccccagagttatcaagccctgtcatcttcatcctcagagtgaagtcaaagaagatgggtttgaccaagtcatcatttgtgcattaaagggccaatgctttttatgtagaaaaaaagtacttatctgatcctcttctgccagagcaattccccctacagccacaatttcaccaattgctttctttcgagtctttttcaaaactgtttttctcacacacaccttgcttcatctctctcccgtactgttgggtttccgttactgttgttgttaatttctgatattcctgaggtgtcctgtgcctgacggtggttttccccctattctctttcaattacaaagtgactcagcactgggcttcgcttccattgttctctgggacctcttccatttatcagcctctgtgcttatcactgtctgtgagtcactctactgatcatttatctcctttcaaagctggcagagtaatgcttcgacgcaatctatccccattagataagattttctgaaatggattcagaatatattaaagcctcatttatctgttattgatgggttagtcaaggatctcacaaagcttcattttccaaataaccaaaacttatcatttaaagaaatagtggctggccgcagaggctcacgcctgtaatcgcagcactttgggaggccgaggcaggtagatcacgaggtcaagatttcaagaccagcctggccaagatggcgaaaccctgtctctactaaaaatacaaaaattagccgggcgtggtgttgggcacctgtaatcccagctactcaggaggctgagacagagaattgctcgaactcaggaggcggaggttgcagtgagccgaattgcaccactgcactccagcctgagctacagagcgagactccatctcaaaaaaaaaaaagaaagaaaaaaagaaatagtttatatttccagaataaggcacgccatcttctattgcatgcctcaggtattgcacgtttgtttttgttatttacaaactggaggtttgcagcaaccctgtgttaagtaagtctattgatgcaatttttccaacggcacctgctcacttagtgtctctggtcacattttgggaattctcacaatgtttcaaactttgtcactatgattgtatctgtgatggcactccctgatcactgatcttgaatgttactattgtaattgttttgggacaccatgagccacgccgatgttaagatggcaaacttaagctataaatgccttgtgtgttctgactgctccaccaacaggccattccctgtctccctccgtctccttgggcccctgtattccttgagccccacagtgtgaaatttggccagttaataaccctgcaaaggcctctgagtgtccatgtgaaagagagggttgtacgtctctcactagaaagcagactggaaatgatgaagcttagtaaggaaggcatatcgaaagccaagacaagacaaaagccaggcctcttgccccagttagccaagctgtgaatgcaaagggaaagttattgaaggacatttaaagtgctccagggaacacacaaatgataagaaagtgaaacagtcttattgctgatgtggagaaagtttgagtggtctggagagaaaaatcaaaccagcctcaacattcccttaggccaaagcctaacccagaacaaggccatagctctcttcagttttgtgaagacagagaggtgaggaagctgcagaagaaaaattggaagctagcaggggttggtttgtgagatttaaggaaagatgccgtccccataacataaaagtacaagataaagcagcaggtgctgatggagaaacttggtaagttattcagaagacctagctaggaacagtgacgagggtggctacagtaacaagaaatttgcagtgtagacgaaacagccttttatgggaagaagataccatctaggactttcctagttacggaggagaaatcaatgtctggtttcaaagcttcaaagggcaggctgactctcttgttaggggctaatggagctggtgactttaagttgaagccaacactcatttactgtgctgaaaatcttagggctcttaagaacgatgctaaatctactttgcctgtgctctgtaaatggaacagcaaagcctggatgacagctcttctgtttacagcatgttttactgaatatttcaagcctacttttgagacctgcagctcagaaaagaaaaattcctttgaaaatattactgcttatggacagtgcaccttgtcatgctagagctttgatgggaatgtacaaggagatgaatgtgggtttcatgcctgctagcacaacatccgttctgcagactgtggatgaaggtggacttttgaccatcaagtcccattatttaaggaatatatttcataagactatagttgccatggatgataattcctctgatggatctgggcaaagtaaatggaaaaccttctggaaaggattcaccattctagataccattaagaatgtttgtgggctgggcgcggtggctcacgcctgtaatcccaacactttgggaggctgaggtgggtggatcacaaggtcaggagatcgagaccatcctggctaacatggtgcaaccccatctccactaaaaatacaaaaaattagccgggcttggtggcgggtgcctgtagtcccagctactcggggggctgagtcaggagaagggcatgaacccaggaggcggagcttgcagtgagctgagatcgtgccactgcactccagcgtgggcgacagagcgagacaacatctcaaaaaaaaaaaaaagaatgtttgtgattcatgggaggagatcacaatatcaatattaacaggagttgggaagaagttgattccagccctcatggatgaggctggaggggttcaaggcatccacggaggaagttgctgctgatgtggtggaaacagcaagagaactagaattagaggtggatcctgaagatgtagctgaactgctgcaatctcatgatcaaacttgtccagatgaggatttgcttcttatagatgagcaaagcaagtggtgtgggacagcatctacttttggcaaagataccgtgaacattgttgaaatggcaacaaggccttagaatattgcatgaacttagctggtaaagctgtggcagggtttgggaggattgactccaattttgaaagaagttctactgtgggtaaaatgttatcaaacagcatcacatgctacagaaaagtctttcatgagaggaagagtccgttgatgcgccaggcttcactgctgtctcgtttgaagaaattgccacagtccccccagcctatagccccaccactccgatcagtccacagccatcaacatccaagcaggaccctccaccagcaaaaagactgtgactcactgaaggctcagatgatcaccttttttagcatgaagtatctttaaggtgtgtacatgttttttagacataatgctattgcacacttaatagactgcagtagagtataaacagaacttttatatgcactgggaaaccaaaacgtgtgtgacttgcaaattgcaatattcacttcattgtggtggtcgggaactgaacgtgcagtatctctgagacatgcctctctatcacaaggcccttcacattatgaaacaggtgatattgaacacaagagatattatcaaggggattttcacagaggggagagactgaaactgggaaaaatcaatatttccttccaatgcttgagtcctgtgatttaccaaaatatcacactttgccctgggccatcacactgagtgtgactttgagccaatggagtgacttcgggggacagtcgcagagaaggacgtgtgcgtctctgcacatcacgggcactcaggtcctcgggcactgccaggcgggtagctcttgccgcctacactaaacgcctcaagactagtttgctttctaagtttttaagtatttgtttttaatcttttaaaaaatctttttacatccctcaatctcaggctgttgcgaccgtttttgctgttgggtgtgcctgcttcgggtagatacttctcatctgttgcttgtggtctgctggcagggggaaaatctgaaaccactctgactagaatcacatcctagctgagagggggcagagggatggagggacatgtgtgagcatattccagggactgtgagagctgacccctggaggacagaagctgccccgtgagtagcctccatttaagtgagtgtctgcaaagcactgcagcctcaagagaaaggcagtccacccacctggcagatgggttgtttctgtgtgcactctcaccttgggctaagagaagcgtgatttgaaatcaagtgcaagaggccgcattttcacctctgtgagaaagacagacttttagaatttagaattcgatcaaacataacccccttgaggtcatcagagaaagtgtgcagagacacagcagcttgtcaggggccacaggtcacccatttctgttgtctcccaggagcctgttcacatcttatagcatatggtcacctggcccgagaatgtctgttttgcaaggtttgtcctgagctggctgtacaaccctctcctgccctggcttctctccaactcctactgtgtgtgtctgcagagctgcctggctcctcgagcctctaacccacctttagtttcacggcctatctcccatcctgactattacagatggtcatctgacattgtgtccagtctgtgagaacggcttccaatgagctgcccttggggtcccagaaccaatgtcaaaaagacatcccagaaattgtgaacataagctcattgctggtctctctgtgcaggccagtgcattttccctcaaccctgtctggcctctctgccacccagggcaaatcctgcattcctaccactctcaccgaccccaagcctcccagagttgaatcactggctgcatggttgaacctagtccccagccccctccactccccagaggtcagaaggctgagccgtcaccactggctcaaagccccaaccctcttatccccatgactggccttcccagcatggccagacccatcctggaaggatcttggggcccaccatgagtccacccaagaagcataagctcagctgtggtctgagaggttcaccatggtggcgaaaaccgtcccagtcactcaggaaactaaaacagtctggaagttccatctcagatcagatacattctttatgataaaccatcttatttggctatatctgtcagatttattcatattttcttttcaggtgggactttttcaacaactttggtttggtttcagaccacaccgattcagattgcagcagggggaataggaaatggggcttgggaggagtagaattgataactggcatttccgcctctaatggagattcggttattggagaactcaaatagaaatgacagctctgcccaggtgcagtggctcatgcttataatcccagcacttcgagaggccgaggttggggaggatcgcccaaggccaggagtttgagaccagcctggacagtatagtgaggccctgtctatacaaaaaataaataaaagaaacaaactattccttttctgattcaaaacttaattcacaattaaagagaaaacaagacgacatcctgggctcgcatttattctttatcgcactaatgtacaatgtagttgcagtctacattagaaatattagtatgcttataaatggtgcgtatgggttagagctgtttcttggggaactgaaagctcaaaacagcttaataaatttcaaaatgtaatgagtacatttttaaaattaaaaatatcaagtataattatggctttgtgttctgacctgtgtgggtcagcagtacctgatgtctgagagaccaaaagctggttagcggtgacccgggtcacactcagcatcccctcttcccggcactgcctggcagcgtttatggaggggcagccatccaggacagccccggaacagggtcctgctccggattcaggagacgtgaaggttcagtacagggcccgggcagctcatggttttaaggttgtagactcagccttggtagaaaccatgtagtagggttttgcagctttgtcactggttaagtcccagtaaaaactttttttttttttaactagtaacttatttaaagaatttattcgctttaattgcatttccatttcatagccttgctgatgtgttctttaccatttccatgggattttagtgagtggtttcaccacacttcctccaaatccccataactccagcagaagacataatgacaatgtaacctcatgctgtcaataaatgcggcaactgtgtggtctaagaatacatgcaggcattttcgctcataactctaaatggctagtgttggaaacattcccgttacatgtatcgggacttttcctgcatatgtggcatttccatgaccagcttctagttgtaaaaaacaaattgttgaccacgttttctcaattaaataatgtatgtgtaggccgggcatggtggctcacgcctgtaatcccagcactttgggaggccaaggcgggtgaatcacaaggtcaggagttcaagaccaacctggccaagatggtgtgaaaccccatctctactaaaaatacaaaaattagctgggcatggtggcaggcgcctataatcccacctactagggagactgaggcagagaattgcttgaacccaggaggcggaggttgcagtgagccgagcttgcatcacagcactccaggctgggcgacagagcgagacttggtcttataaaaaacagaaaataataatgtatgtgtaaacgtctgcgtcccctccccctatttatgtgacagcgtcagtacttgttttggtagctagcataagggttccatgaaattatgaccagaaaacaaagtaacactgtgaataatgaagctgggttttgtgtgtccttttctggggggaagagagttaatatttgtgtttgggcatattttatgttattcatttcccaaacatgacacagcaggacggtctgctgtaagagctcaggctcaccatggattctgacatgtgttttcctctttttccttttcatcccattcaattcaagtgaactgcctcattcacctcagaacctcctggtcagccctaattcttcccacagccacgccgtggtgctctcttgggtccggccctttgatggaaacagtcctattctttattacatcgtggagctctctgaaaacagtaagtagcaaaatgaaactgtcaccatggacgataatcagatttttgtgtgtgctcttaatgtccttaacctttacttctgggtcagacccaaaacaactactaaaatgctgtaatgctttacagggtttcaaacacagcctgccctttaggaaagaaaaaaccatgcaggacctgagagagggaagggaagaagtccttagttagaggggctcttggtggagagtggatttggggccccatgggagggctgtgcacacagggctgccccgcacagtgtcactcccagggcgagctggaaatgggttaacaatgcctgccacctgggtgacttgagagttcaccgtcgccgccactgctcatgtctgtgggaggttttctccggtgtagacgtggtgtcaagtgttcagcaccctcttcctgactcaccttccaggacccctctgcccatttaccgccatccttggaactcttctacatgaaacatgctccttccgtgggccactcacagccttggctctcctccagccgccaagccctccttcccttctcttcccagctggctgggtgacgtgtgccccgccgtgtgcacccactcacgcctctccgctctccctggaatctcttcctgggaaatcgcatgcactcctgtgattttaagtggcatattttccttgatgactcgaacatttgtatccttcacccaggattccaggatcacttatggggcccagcaacttgacatctgtatcgggttgtctcacggcctctccagcttaacttcttcccactgcatccatctttttaatgtttttttttttttttttttttttttacctcactcctgcagccacccaaatctctgctcccagcaccccgcatttctatattcctctgccagaaccctaggaatggtccccaattcctttccctggaccccagcccccacctccacaccccctgcatcagcagtcctatcagtctgttaactaggattctgatccctttcctctctgcctcagaccactggtacctctcgccaggaccactgcagcagccttccagccggccctgtttcctcatccaaaccattcacctgccagcagcaacactgatcttcctgagatatacccagaccaggccactcccctgtccacgtcctgcaggggttcctgctgcgtgcaatatagaagccaaatgcctcgctccctgtgcagcctcgggtcaccctgggctactgtgctctttctccacaccggtcagccacacgggacacatgaaactcaacacggattttatgttgactccctgaatgggccaaatatctcatctcatggcatgttccttcccctggaaacccatagagctagattgtcacccttcatgatagataatccattacctccacaaagaagctctccagcacgccagcccgatttcaccttttgttttttgtttgtttattttgagatggagtcttgctctgtcgcccaggctggagtgcagtggcatgatctcggctcactacaacctctgcctcctgggttcaagcgattcttctgcctcagcctcccgagtagctgggactacaggcacctgccaccacgcccagctaatttttgtatttttagtagatattggccaggctggtctcaaactcctggccttgtgatctgcccaccttggcctcccaaagtgctgggattacaggcatgagccaccgcgcctggcgtccagtttaaccttttaatacgtaagctgccggcctccctctgttatcctatctgtattagtcggttttcacactgccaataaagacacacccaagactgggcaatttacagaggaaagaggtttaatggagaactcacagttccacgtggctaggaaagcctcacaatcatggtggaaggtgaaagtcatgtctcacatggcggcagacaagagaagacagcttgtgcaggaaaactccccttgtactaaccctcagacctcgtgagacttgctgtcaggggaacagcacaggagagacctgcccccatgatccagttacctcccaccgggtccctcccacaactcatgggagttcaagatgagatttgggtggggacacaggtgacccacatcacccatcatttattccagatgagggtctccttccctgagcctcccccaggcagagccagatgcaggtatcctggctgttaacacgatccactttattcggcctgtggttgtctctggatgatactggtgttctaaacgggtccctgttttcaggacacctaggagtggtgcactctcgggtaccctcccctgaaacccagctccccgtgggtccctggtgctgctcacttttctgggcagattcagcctgagttctgccgtggctcttcccagctgatgtcagcctgtacacgcccccagcaattattgagataactcactttatttctcctaattacctttctacaccctcgcccttccctgggggttcccttctgataatactgcatgttcacaccacagccacacagtttaatccccatttcatagctacgggaatggatgtgcagaggctgtaagtcactgtcaactgcccagggtcacatggcgatgggaggggaagatgggatccctgtgctgtctgactccagagccggtgctcatgacgagtgtcaggcatccgcagaggagccttcggaagcagagtgtgctgtcctgcactacagcggggcttcagggagaggccacacttgggcgttggtctgtgtggacgtggaggaagccactctgtgaatctgaagaaccattatttgagttctgcaccacgcaaaccagttcaccgagggaaggcccagaggcagtatgttattccgggtcttaggcttctaaggttacaccttccagtcctgggcaccacctcggagtgaggccagagtccaggcccttctcccccttgcaggggcatctctgaggccggagtccaggcccttcttcccctgcggggggcctctgcaactcccactcgggcctctttcctcccagagatggggcaggatagaaaccagcgtgtgtgcagacggccatcttagcttccattcaacggctctgaccgaacggggaaggccagggtgttactgattcagataacttctgagagtacagaagagtttcctgaggatggcgtggccatgctgcctgtacgtaaaacaggacttgacagtgatctggacggagagaatgggacaggggagagctcgtgtcatctgaattctggttcgcatccaccctaaggacagcccccatcaggcgctgtcgcctcgggcttcaggactgtgtctcctttgtcttcgtgctcctcattccctgcacttagtacgtactcagcaaatgaggtgaaattcatctctccagtggagtcctcttgtgatgcactgaaaattacagtcatggaccgtcttccaaaacagaggcattctaccttcccccgtttccatgaaagaaggcatggctttgagatgcctggccagcgctcttctcagctgatggcatgactggctcctccagccagttagcttgcctccatgagaagcaggtttcgtgtgtaactatccagccagccacctacctgttacagcggtgaagccagctgggcatctgctctgcactctgctgggtgctgggtgcagagctgacgtgatcagtgtccactgcgaacagcaaggagacagtcagaggcatcgatgcagcctccacgtcgcacgttcccggctaggtacgtacatagtgatgtgactgtatagaaggcaagtcagagaaagtcttcaaagaagatgtgacatgagacctgggccagacgggcgacgagggacagcatcagcaaggacccctcagtgccaggcccccaggctcagtgggaaacaactgcccgtgagatggggctggggcgttgctggcggcgtgtattggtgttacctgggaaagttcttcctccttcttggtggcttggatcaaatatcacttctgcaagtcccattacgcccaggcagaaatggcttttccctcctcagggctcccttgctgttctacatgcttccctttgcgcacctgcgacgtaactcctggcttgtgtccatctcctggcaagactgggaaccccttcagggcaggtggggtccctgtgttggtcctctgtgctgtgacaccagcacagtgcctggcacacacaagatggctctgtaggtgtccagctgcttaatttcactcagaaggggacagagaacgtcagtcacccatattagcctctggctctcctgaagctggccgacgttcccagctgtctttccttcagagcctggagtgtgggtattgtggcatgcagaatctagagtgggtaccatggttgcctcctgcctgttctgatttccactgtgtgaaggaagcccgtgaccttggctgaagcagcctgtgctgctaccagctggttggtccgtgtcttcctgctgtggcaaataggaagagtaccaccatcatctgggccagtggtctggtttttatttttattagcaacaaatgcccttaagaagcagctgaacatgctggctaattagagccagaaagaacagcttagcagcaagtgcactaaaatggaaattgcacttggcctccactcagcgtgtgcaagtggtcagcactaaatagcgccatctactaggtctgtccctccggctacttgggagacactccacagccagctcctcctggcaggctgactgggatgccattctcctggaagccggggatcctgcaggggccaaacccacatggtttagtggccgaggcaggcacttgatagcctctgccctgacgacattcctgccactgcagaagggcctcttccgagctctgtggagcagagcctggggcttgaactgagcctgcacccatgtacgggactcaaggtgcatctctggatgggagatacacgtggccctctgcaggcatgccagggtttgcctctctgagaagtttgatggttctcctgtcccaggtgcctgtttagtaagcctgggactcagagaggggcagtagtgtcctaggcctgggtcaaggcacccacctggtggattgaggagggcagagggtcaggccaggtggcggatgagggaagcctgggggatccctgcattgagagagtgcagggattcttgatggcttgacagtggggaccctgtgaccaggctgagaattctgttgaataatgaaagcatttggcccactctctaaaatgcttatcgattatgatcaaaaatgatctttctttgagattattatgatcctgtggagggagactgtcaggtaagaattgtgaaagactttgcagtgtgccataaaaaggattactgagtgtctcatctagcgcccttcagggttatctgattcgatagggacccgcgctttccatcgtctttgggctacttatctctgtaaattgtagaaatcttatagtagtgcactttgagtaatgcaaatttcttttccaaagaaatgcaaataaatgcaaattttatcctgtagaatataaatatggctattgctctgcagatactgacccgttttgcatctatttataaattcatttttgcactatcaatatgttgtgggctgttcactttctcttttgatacagttgaaacgtcttactggttccctcataaattaatgacaactaaaatctttgatacatgttgattctatcgttgcattagagccgttattttaccttcttaaaaatttattctttcacatgagtgagtcggcattgcacagtgttagaaatggagattttcgtttaatgcaacagttgccaccagtttccacggcaaccttgatatttgggagaggccatcctagttctcaaactgagcctctgcgtgttttccttgggctggacaaaggcgtcccatggctgaaacagaagaatggtggccttctaccagttatcaagaaaaattaagtctttttcttatgatttttttttcaaccttaacacctgctgttgtatgtcttgtggtaaatgcttgcaggtaacaaacatattaaacattcagaatccttcattctactcagtcctacggttagttttttaataggatgagtgttcgtaattgtgattccctattataccttgtaatatttaaatttaattaaaatgtaaaatacatttgtactttttattattctagttatgcatgctgattaataaaaatttagaaatcccttaaagcacaaagaataaaaacgatcactacagtcccacatatgttgaaagccagccctgcacccaagcccttggtccctcctccagcccttcctccaggacttggctccctctttatttcctctctgtgttctgtcttcaaagctctccctctctcctggcttcttctgcctcaaaggactgagctctgctaattacctgcacctcctcacttctcacgcattctatctactcttctctcctgaggccatattgtcgttgttgtaaaggacagagccagtgagctccactgagtccacatcccctcagcttctctgcaagcaatgctcttgatcactctccccacacagacctccttgttcccaggacttggcttaagtctttctcttcattcttccttcttattttctcctctctatccattttctctgactcattgaaggctctatttcccctcctgcccctaaaatgttggcattccctgctttgtctcactcacacactggtcttcttatcacacatgcttttctagggatctcatgttagtccatggttcacctttgacccacacaccataagtccctcatgtgtatttctaacctagacctctctgctaagcctcagattcttgtaaccaaatgtcttccacacatctacacctccatgtcccagggcttatcagactccaactctaaaatagaactcatcatctgaccccaaagttgttcctcttccaagttagagataatgtccaggctgggcgcagtggctcacacctgtgttctcagtactttgggaggccgagtcaggaggatcacttgaggccaggagtttgagaccagcctgggcaacatagcaagaccccatatctacaaaaaattaaaaaattagccaggtgtggtggctcatgcctataatcccagctactcaggaggctaaggtgggaggatcacttgaacccaggagttcaaggctgcagtgagccgcgatcgcaccaaggcactccagcctgggagacagaatgagacttcatctcaaaaaaaaaaaaaaaaagagaaaaacataatgtaattcttgactccttcaccattaattctctccaacaaatcaatcaataaattttatagggtttacctcatgcatttttatcaaatccactgccctgcccttctttgttcctgccaccactgaccctaactggctgttgcccatcactgtgatccatggatctgggatcctcaaatccatcctcccttgagccaccagagcgagctcagtagtacaggaacctcactgagtggtttcccctgcctgaagccttccagaggatctgcagagaacccaccgctggggctgggcaggaaggcttcaggaagcctggtactgtagacatggcccatgtcctccctaggttgccagccctacttcttccgtatagaggttctcgttccctgaagaggggattctaggcttcttagcatggtagcagcactgtttactatctgaccaccccctgcctctccgatttatctccagccactcaccattctgctttccttacttcagcaacaaggcattcctccggattccctgggcacaccagatattcagtgccactgcacctttgctcaccgaatctgggaattctcgccctgatcctgtccccctctgcctttgcctgatcagctcttactcagcatctccttttaggcattgcctctggtctcaaggtgctaccccatctcctcccctaggggtgccacacccaccccctcccctgggagcgctgtccccatcccctcccttgggggcgctgtccttatctcttcctctacttgcgttgtccccatcccctcccctgggggcgctgaccccaacacctccctcctgagttgcctcagcagtgctgaatcaaccaatgggcaaacagcctttagggcaccagcaaaggcaagacagcaacactaatgcaactatctagaaggcaatcatttgaataatctttctactccaactacacgaagataccctcctgtgtcttcattcaggaggttgagggttctgagtttcgggtcttctgagggttgttttagtttgtgtttcgactgctagtattcttgaacccattctgccaagtcggttggctttgagcactttctctgctatgatctgttcattttctttgccccatttatctatccaaggccttagggattttttttttttctgtcatttgtaacaaggattttttcagtttgcttttaccattaatgtttgtatattactttctgacatacagaagtgtttgacttttacgtagttaaatctattgatgttttcctttgtcacttcattacttttgtgtttggatatttcaacactctcaagcctaaaatgagtattcttataggtttttgccttgtttataaaggtttaatttttaatatatttaactctctaatttttctggaatttaggtgtgttatatactctggcacactacttttcctttctttcaaatgatccattttcccaacatgatttattaaataatctatttatttatggtgtctccctctttttatattcagaggacctgtttatacaaaagtctgcttgtggattatttagttccattgattcattatctctttttctgccagttttatagtattttaattgctttacttccaaaaggtgttttaataactgataaaacaactctcttcaacttttcagaattttgttattacttgtcatcatttattcttccagaaaaaactgaaattattttgtttcaaaagtagtctcattgcatttttaatcatgttaaacctataaattgttttatgagaagtgacttcttagtaattctggttttccgtccagaaaataatatgcatccctatttattcagctgtttagtgaggtttgcaagtttatacccataggctgtatacttttttgtcaaggttgtcctgagattttgactcattgctactgtaaatagcaatttttccccatttcgtcttctaattagttattgtaggaacataggaaaaccactgatgtttagatatttattttccattcagccatattccatattcttttattattctaacgacttttccattgctcttctttgctttcaaggtagacgatcatatcttttccaaataatacaaatgtattgttttctttttgtttttcctatcttgctgtgttggttggaataattttaaataattggcatagtaatgtctcttgtgtttttcctgatctcagtggaatgtctactaggattttactgttatgtgtaatatagattgttttttattgagatataatttgtatgtaacaaaatgcagggagcttaagggagttttgacaaatatatacagccatatagcccacacctcaaacaaaatacaagtcatttacaatactccagaaagttcttcctggccctttctagtcagtctaaccccttcttctgacttctgtcaccatagattaggttttcttgtttttgaacttattggaaattgttacgggatctttggagtgtcgcttttccagccagaaacctctgtggctggtggcggttttgtccgagttctcgtcttgtatccaggaagaataaggttcacagacaaatggagggtgaggaagatgaagaggagctttattgagtgtccggacagcccagaggagccccgcagtgggtggctgctctctgtaggcaagtcgtcccatcgtctctgcagctctcagcagagaggaggcctggagtggaatttaggtgtgttatatacacctctgctggcagctcatcccgacaagtgttcagctgtcagcagagagaaggccctggagaggatagtagcttctctctgcggctggtcgtcccagcatctgcagctctcagcagagagaaggccttggagaggttgttcaatgtctgcagctctcagcagagggtagctcctctttacagctggtcctcctgtcatctgctcagctctggctgagcccagggtttttatggccttcagaggggaggaagtgcatgcggattggtcaatgggtgaccatgagtgggcctggaaaaggcaccacaagttcccactccagccagggggactggcagccctgcccccagcctccaggccctcactggcctgaaggtggggcctcaccggagacccaccttcttctgcccaggagtctgtctgcctcctgctgccattcatggcactcatgctcgccctgactttgcccccagatcagagtgggtgccaacagcagggagcagccaagcagtgagagcaggcacttccaagcctgcgagggcagggggtcttcctgggtccccaagagtgcaagaatgcctgagtctgcagccgcgggttttggcagctgcagctgtgcccaagagggcagggatcctgcctgctcccagcccgccaagagcacaaggaggctaggatctgcagccacgacttgggcagggctcctgcctgctccatggaatgggaggcccaggtctgcagccacggtttgggcatctgcagcggcaccccgggagctcccgccccaactcgtaaggggcagagcttccacttgtccccggctcctatgggctccttggagcaagcggccccggcagcacctccctgcaacagctggcatgatggcagcggcaggctgtctagagcagctggctgctgtcatcaaaaggaacatgatactgacttgaatgagcagttttgtttatcatgtaatacattccttccattcccacttcttaggattttttaaaattatgtaggaaaatgttttatttctaagcaaattattcttaaaataacaaaatattacatttagaaatacccctacgtttatgtgagagaattcagaagatcaatacgcttcagcttttgggaattcatgcattcccaaggccctgccccctggacaggtttcagagctgatgctctgagggacgtggtcttcatctatgactctaggttccccagcctcaaacctgaaataatgtacttttccttaactcagaaagaagccctgttttctatgaattaggagttaatcccatatcttcatgttttctaacaatgtgcgggaggaacaacacctccgtatcttccgcatcgctcgctgtcttccacgtggagttccgtgcagtcggcgtctccactgcctagggagtgctggcttctctgggtgaatgtgggagcttccttttgcaagtgtgccatccatgtgtccctttatgccttggctaccaggaagcccaaagctaacctgagtgtctaactgaagtacctcagtcattccaactgcttagaacatctccatctctttgcattcttctcctttatgagtttgattttgtttttgtttgtatgtatgtcattgtatcacccaattttatgcagattttcactttagaatatccttaagctctctttaaaaataggagatatctctccccaaacacacacacacacacgcacacacacatgtatcatgtcaccatactttaagggcaggctcatgtgaaatgagccatcgaccttctttctctcctttagtttctttctccccattcccttgggtacagagcacagtcagttcacgcaagtctgcaaattgcgcatccactccctcctgagagcattagacaccaggagataccaggaagagcgtgaggtccattttcgaggcaaagaacactcacaaaattaaatcacaaatccaagaatatacgagggggcgtcgggtagtatgtgatcgcttgccaggaaagtggatctgaggatcaagaccgtcagggaaggggggttccctgtgggcaggtgtgggcatggaggcccttggaggtggaccctgagcagaatgttcaaacggtcagtattcggatgccctggtgcctcggggcgggggaggctggtggccaaggactccgaggcttggatgcagggcagcaaaatgggagttcaggaaatttcccagtgagtgaattcgtaagagcagaaggatctttgagcaggagaagctggaggctggaggctgaaatggactgctttataaaaaaccattttctaactaataatgtatttttaagtacaaagtaatacatgctcattgaagctggagaaatagtagatgatgtataaagggagagttcttatctccccccaccatgagggagcactgctagcagcctcgggtgcatcattcctggctgaaaagggatgcctgcgagggacagagagggaccaaatgatgccagacccgagtcttgtacaacaaagagctgcacaaagctgggagctaggcaaggtggtgtgaaagcaagtttttagcaagattaacctggcagtggcctacagggagctgtctgtgaggctcagagagtgaaggaaagcaggaggctgagggcctggagcaggaaggtggtcattcccgaattgctgatggggtttccctgggaaggagggggcccaagatggcctagagccccaggcctggacgtggaagtaggaggcctgctgaggaaaccggtctgggaagagcatctgtgagcttgactagagcatgctgaggctgagatgatgttctggggttcaggttgcaatatcctccaggcagcttgtccttcctccagcatggaacgttctggtgcccccagcggcctgatgcttttttgtgcctctccgcctctgctttctgaagcacggcttggttttgtcagctgctgggccaagactagcttttggagcacgttctctgagtcccagtgcctctcctgagcccctccccagcatctttgcaggagaggttcttcctccacaaagagaatctctgagctgcacggctgggttggttcttcccctgccacaggtgccttttcatgtagggaacccgtcagccgtctccacgccgctctccatgaaagctgctcctggctgtcaccgcacaatctgttcaacatctccatcccctgttgctattatggacttaaaagctgatgggcgttgtgctgttttgcttgccaaaatggcgaagagactttgttcttcatgcttcaaatattttaatactgtctttgaaacacacctcacacaggcgttttctaatggcctcggacttttcggggagcatttcatattttagctcgtctttctttgggcttttgctttttaagcctcccatgcatagcatttgtccgcattttaataaatgcacatctagggagacagtacctgtcagaggtgtttatgaaggggggaccatggctgtgttgggggcccagagggggctgaggtctgcttctgcgttcacttcctgttagcttcctgccctcaccaagacgagatgggggtcagagagcccagggtggctcccacatccttggttggtcctcaccttctggaatcctctggcccaggctgtcccacaggatggtgtaacttcctgcgtgggagtgcctgtggtgaccgcacggtgcggaatacagcgtggctcccatagcttgagctccaggaggtcaggccagcttccatctggagaggggcccctgctccacccactgcctgccagctatctccagcctgttgcaggggtttgccaccattaggattggtctcccacccaagatcgagttccccaagcttctggatatatccagtcaccatttccaacctcctgccccttctctggagggaatggcttctccagcacataggcccacatctcccggtgagcatgtgtctccccttgggtccaggtcaaagtctggcctcggtgggccacctttggtgtcttgacctgaggctctggaggccacagtgccctggatgtaagcagtctacggcctcaaagcctgttgtgggatcatttgggctgcatccattagctgggggtttcatgtatttctaaatgtctcagctctttagttcttaactttttaagacaaaaacttggtgcattttaatcctgagcttgtagacctttatggtttctctaaagacatatacaacagagaaagtcttcccaaagggaaggatatcaaaatgtatttatactgtccactctgtggtgttttgttttaggtagaaagtatccatctacttcgtactctttcttccccctgttctatgaagtctttgtctggcctaagcctctttctttctcaggcgtcctcagtggtttatccctgtcactcctgtggcctctgtcttctcttccagggttgccaccacgaacaggtctctctcacaatgttcttttcaaattgtgtttgtcttagatgtgtttcatgcctgaatagagtcacattcatctgggggccctcgcagtcccctgcaggagtacagtctgttctacaaatgtatttaccagcttaagcttggaattctacagtgccactaaaaattatgttccttttgtcactgtcagagtttttaactagaatcctgcagaaaacactttatataacctttgcataacgagttattatctatgcttctctcttagtgcccagatgagctctgactagaccaagagaagctttttcgtagccctggctgtgcccgtctctgagtctgggctccagccggaggggtgagtggctcagagcaggagtgggttccgaagcctcaccccaagcagtttaactgcatggaggctgaaattctttgttgtctgggctttcaaaactgtgttatttctgttcatgtgacgacagtaatttaagggcgctttaatatagaggaggaaatgtcattccttccaccaaactaatctcagtaactcactgagctgaacactaagatacaggtcggagtctccaaaaacgtgaaagtaattacccaaagcattgaacaacaatgagaatggtttaaaaaacaagaactgcagtatggacctatgcctgtttcatttcagttccttcccatactctttattttccaaaaattttaagtgaacttctatcattttttatggtataaataatgtacatacacaaacatatatatacacaaatacatatacacacaaaatatacataaaatttaccattttttacccctttaaggtggaaaaaaatctggttgggagatggatatctggttctcaggggtggatccaggttttgttgtgtaatttcggagctcttgttaagaaaaataatacaaaattgaaagagcctctgctgggacccggggagggcccgatgtgatgggagccaagagctccaggtcgctctgttcatctttcttctggggttggcatgagcttccttcccagagggcactgggcagtgctgtttgcagctcatggagccctagccctttgctactgctccaccccatgggcatcaggccccccaacactgaggagttcagcatgagccatgtctgggacagctcattctccaggctctagcctcaaggaggaatcccagtggctttaaccccagctctctgacagccctcactcttgtgtgcctgggcacacgcatgtggacacatacacacagatctgctcttctcatgcaaaacacatgaccttccactgcaggttccacgcagggcctcctaacctgcccctcccctgcctgctccagaccaaccactcatggtaggtctttcttttttcttactaaacttggtgttttagagcagtttggagcttacagaactgtttcaaagatggacccgccacccagcttcccctgtgacactagtatggtgcctttgtccattcattgagcccacagtgacaccttattgttcactgcagtcactgcccccttccgagctccgcagtctctccctgatgacgtctttcccgctctgttgcaggatcccgtccaggatctgttttgtagaacgtcactcaatcgggatttgtctgatgttcttctcttagctagaccaggattatggggctttgggaagaagaccagggaggtaaagcgccattctcatcacatcacatcacatcaagggtgaaccctgtcaacgtgactcatcactgctgatgcttgctagaccttccagacacggggaatttaacctgatctgtgcctagggctagactctcagcagcacctgtcttgagtgtgcagtgccaccctaaggaatgcagcctgcttatactcagtgtctagagagacagtctgttgtggtggaggggagcctctgattagcgtgaagcctccccacttagctccatgttgggggccctcgcgggcattgctccaagacaagctcatcttctccttcatctctgtgaccaagcccttaactttgcagctttaaatcctaggcaacaatgagatgtggagtttgcacaaggagcattaatggagagtggagagaccctgagccttcactccatccatttctcatgtggaaatgaagatcattttatccccctcaaggttactgtgaaagttgaacgtggacacatacagccatcagcagtagctccaagagtgggtgcttttgttccacaaacacttattgagctcctactgtgtgtcaggcactcttctagttgctgaggaccaaacagggaataaaatagatcccaagggagctcagccagtggataactcttttcatggatcaccatgattattgtgagctaatacttatatttcaggagattcaacatgcagactgttgtagcaaaaacagtagtagaattcaaattagaaaaataataaatttgcacctaatttttccacttaactgtaacctgggggaactatccttattttaatgaaagcatgctcattctcattcatataaaaatgcaaagtaaagcatcaaccaaattacatttttcacccaccaatagacaattacaacagttataaaatgctccatgctggcaatgctatgacaaaaatagacactttctaagaactttttattattagaagtactaaatacacacaaaaatatagctccaacaaccagtaacattttaaccatatttatttcatctgttcctcactttccttttgctagagtgttttaaaggaaattccagaaattatgtcaattcatccctaagtgatcagtaagcagttcaaaaagttgattacacctaacaaaattaatagtagtcattaatatcacctgctattcagtctatatttaattttccctaagtgtctaaaaagaaaggtctttttacacttgcatcaggatccaaacatggtccatccatcgtactggttgttttgtgtctcactgtgtcttcatccacaaaacccccttctacctccccgcttcctgcttgggcagagtccatgacagttgtcctatagaaggccccaagtcctagattaggattctggtaattctggtgtttaattggttcctgcacctttttttttttttttttttttttttgagacggagtcttgctgtgtcaccaggctgtagtgcagtggcttcatcttggctcactgcaacctccatctcctgggttcaagcgattctcctgcctcagcctcccaagtagctgggaatacaggtgcatgacaccacgcctggctaattttttgtatttttagtagagacagggttttaccatgttggccaggatggtcttgatctcttgacgtcgtgatccacctgcctcggcctcccaaagtgctgggattactgcaccttctttattgcctggagactggatttgagctgccttccgtttccgggtagtttcttttcttatgtgagtgtgtgtgtgtgtgtgtgtgtgtgtgtgtgtgtgtgtgtgtgttaatacttcttgggtattgcaggtacttcctgctgcatcacccaaggaggcacatgacaccagctgccccgcttctggtgatgttgagatggagccactctaggtagccgccacctgtgaaattcagcagaagttatttaaacttccctgagtcttggtttcctggagtgaaaaagaggcgcagtaagacctcctccccaagcgggtttctgtggctacagacccgaaagcacttccaggcggcaaactgccacagaaatattatgtattaataatatgatgatgcttttggcaattaaggaaaatctccctgctgggcttggtggttcactcctgtaatctcaacactttgggaggccaaggcagacagattgcttgagtccaggtgttcaagacaagcctgagccacgtggcgaaatcccgtctctacaaaaaatacaaaaattagccgggcacggtggcacacacctgtggtcccagcctgggggatggaatgtattgtgggaggtaggggtggaaaagaacatgactaaggcaggaggatcgcttgaacccaggagcggaggttgcagtgagccgagattgcgccactgcactccagcctggatgacaaagcgggaccctgtctcaaaaaagaaaagaaaaaaataccttctttcaaaaaacatgttcctccttcagacacctttaattgagaaactgataatgctcttttttattggaaaaagcttccagtacattttcaaagattggaaaccaccagctttttcaaccaacagctaaagcggggttgtgattcattcctcgtgattctcggccttaccactaagaaaacgaaagtgtagtgatgccctctgtagaacggagcctggctggggaagtgtaaaatccctcagtcttctagatctgagagtccctgaaggggaggaaaaaaggtattaaacgtttatgggatggtttcctttatcaaaagattcttctacctcccagcctccaagacaagcatcctgtggccctcttctgtgaggaccggctgggggcggacccttttaaagggatgttgcttattgattgtcaggaacagacttgctatttaaattttaacagttctcagcaagcttgcaattccagagcttgagaatgagcaaatccttcccaaaacaatttttttttgtatgaatcagggtgcccagagatggatcagttcatttgtattagttttcactttaatctctcttccagccagaccttttattttctagtgaaagaggaaaaagaataaagaaagaattcctatagctgcagcaggactgggcaggccccgagatgcagaggtaattaataggccctgttgtcaaatcaaaccaggcagcagactctgaaccctgaggctggggttctggactttcaggagctgtttacactcggagtgaacaaacagccaggatcaggcagggccaggctggcgggatggggccgagggcgggaaagcggcgtctccaggcttgctctgcctctcccgcagtctgattaatcgcctcagtcacctggtttcaacagttgtcctcttgactgtctctttctgaaacgatgtttgttcactgtgcctgacggagcaggtgaatggctgactgctagacactgtgatgtctgaaggaagaaagggatggacgaagagctttactgagtccagtatcagtcaagcttcctgagggaaaagatggcgttcctgaatgagagcaatcaaggaggaagttttagaaggggaatgtttgcagaggtgcgggtggaggggaaccactgttaccgggggctggtagcctcagagcgggtttcactctaaggttcaagagcccgaggcagttgcagaaccccagaaggagagattatgtagggtggctgcttggaaaagagggggacccaggtagccccaggcagcctcccagtgaggaagaaagagccttacatttgctcccctcatctacaggaagcctcggggcaggagtcccgaggacagagctggatagggagggcggagcttggatctagggagagcaagctgtccagcaccctgggccaagcttacagctagatgctttcaatgtatgtgatttcatactcggggagtcttgggggttatatattatcaccccatcttttcattatttcctttaatttgttttttgagacagagtcttgctctgtcgcccaggctggagtccagtggcgcggtctcgactccctacaacctccgcctcccgggtttcagcaattctctgtctcagcctcctgagtagctgcgattacaggcacctgccaccacgcccggctaatttttttgtatttttagtagaggcggggtttcaccgtcttggccaggctggtcttgaactcctgacctcgtgatccacctgcctcagcctccaaaagtgcagggattacaggcattgttttaatctttaatggtagtgaaacacacataaaaaatccatcatgttcaccatttgtaagtgcacggctcagtggcattaaacacattcacactgttctgccaccgtcaccaccatccttctctagagctcttttcatgttgcaaaacttctgcaccactaaacagtcgctccccgttgccctttcccctgctcctcctactttctgtctctgtgaatttgttctagatgtctcatgcaagtggaatcatacagtatttgtctttttgtgacttatttcatgtagtatactgtcctcaaggttcatccatgttccgccatgtgtcctaatttccttcctttaagaagctgaatagtagacattgtatggacagatcgtatttgtttacccattcatccatcggtgggcagttgggtttgttaggaataacgctcaaaatcctaaggaaagtgaacacacgaacaaaagattcttagcaaagcaattttacttctgcgcagaggggtgcctccttggccagtcgccatgacagcacacctgaacaaaggggcacgagagcctttattcctgacgcaagtcctgcccctgtaccctttccccattggccggggtcgggtcatacaatctaaactaatcccggttggctgaacctttgattttttttagataaggtgggcacgtaaaagaaagcgaagaggaaaggggaaggggtgttctgtaatgaactagaaagttagtcctctttccaaataaaggaaggaatgtgagctgctactgataatgcctggtactgtggcatgcctgggcatctaacaaaggcaaaaaggaaaaaaagggaaagggcagcagggggaagggtactataaattaaagaataaaagattgattgggttctttgaagagaaacctcatcatatccctcaggttgcttctaccttttggctactgtgaataaagctgctttgaacccaggtatgcacatatctcttcgaacccctcctttctgttcctttgagtgtatactgagaagcagaattgctggattctatggtaattctgtcttaattttttgaagagccaccatactgttgtctgtagcggctataccattttatattcagaacaaccgcgaaatggggcggaatttcttcacatccttcccaacacctgttattttctgtttgtgtgtatgtgttttcttttcataatagccaccctagtgggtattagatgcaatatcattgtggttctgttttgtccactgttttcacggaagttcaaacaaaactgaacacccttaagtgggagagctcgtagtcagctgtggtctccatgcttctttcttctacataccagttctcttcagaatgagaacggtatttccatggaagctggacttggcacgaaggggccctgccttctaccaaccgagtctggttgccctgatactgggaatggcctttcgtcttctgcattgacaaatggctgttttctgtaagggagactgcttagcaaaccagatcaccatgagctgcatgatacaagtggaagggttttaggctcccagagtaaaaagggaagttgctgtgagttcttctgtaggtaactgggaatgcgcacattttgtttttaaaggagacacacagagagggggatcctcatcagctgcccattatccatgtcactggaaatcaaaagccaagaacgctgaaatgcccagctggtggcgaagactgcgttcccagaaagccatttttggaagcagcttgatttgaaataattaaaaagatcccatcttcatcgccaactggcttcatgcttcagagcagcttaactttgtgttaaggaatccagtgagcagattctgaattagtgatagacacctctgtgtgaggcaacagaagtttcctttgagagtctcattttcattttggagcaatttatggccactgcttggtgattggtaaggagctggagtgcatttccaatgagctcgcaggcgcagacttacgaatccccgcggttggggctgcaggtttttggagaagcggctgggattttatgtgtggatgctgacacgcagctggtactgtctgcaggctctgcctagcccaacactatggtggaaagcatgtgccacctctttctgaccatctctaatgtgggtgaaagggaccttagcgccacttcaggtcagcgagacagctcgatttccagaagaatttcccccacccaggttttacttcgctagtaacttgaaaattcagttcaggcatcatcacaattcagaatgggaaccgacagcggatgctggaagtcactgccaagactttgttcattccagggcatcagtctacaaaatgactgggctgaaaagcctgtttaaactctgcaaaaaatccacgcaagggtgtaggatctccagcagaaccttcggaagccttgccggcaagagtgcatttggctggcagagtccctcttgcacacctgctggaaagctgggtgggaagatattctaagctcgctgtgaatttcattacgcctctctccagccaaagccactcaagggtgtggtggtgtaatgggcctgccacgcagatgggctgcgaaatacacagcccatctgtctttatcatgctcatttcctcttttattaaaatgttaatgaatatagtttttatttatcattcagtgacatgtgcagcatccttttctgggagacaaatctgcaatctgcctaaccatgtgagccgacggagaactttctccccttacatactgaacacaggaattagggacgttttggttccttttaaaccgccgtatgcaggttgcacaaaaaaatccttttgctcattgatggcggcaccggggaagttgcctttctggcttgtaagttactagccacatggccagagcctcagtttccacacctgctaaatgggataagctttccttctcctagagctgtcctgctaagcaaatgagatgttccctgagaaagcctttgcattcacctcttattattcagacatgataagcctgtgggcttgaattcgttttcttcattctttcagactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggtgcgtgaatcccgccccaggtgggggtgtggaacagccgggggcctgaatgccaaagagaagcatcacattatgtggtggaattgatcacagcaacccgctggcttccctcagggagacgggacaaaccgtgagcagaaaagcctgtcgcaaagagggaaagacaggcccacgcagacttagctgggccttccttcattgctttgaggcaggttccttggatttttcctgtggcgatctggctgtgcctacataaatcgctcctgacagcacagccctctgtgtacaggaaattcagagctcacatgttttccgtgttctttgtccaccccactgccgggtggacgctgatgccacagtcttagcaagtcaacacctagcatgctgttaagggaagctgtctctgcagaggcgtcgcattcctgagcggtcttcacgctctcccatccctgcgagggccacctctgaaaaatctcattcggaggtgacatgggaaaatggcttcatcacatttcagcacaccttccccaaccaacctgagctttcagtgggcttgacttgtagaacagctgagctgtaaatgcctttctttttttttcttcaaaatgtgggagtttgatatgagaaatattgaaagagccggagaaaacagtttgggaggagtctgagacggcaggccgacgagcggacgcattcaggcttgcagtctttctaaagggctgaggtgctggggttattcacacagaacaaagtcacctccacctttcctcgttgcttggttaactgattttctattatgttgatttgtggtaactgtttctcacgtcctttcagtttcattggctgtgtgttttgcttttcctgaaacccgatttttgtgaatagtcaggctcaagattcagcaagatagatgaaatgcaaatgggcccccgctgtttctggtactcatctctcttgttcctacccgtcttttatttataggttgatgctacctgaagaaccacccagtgctcccccgaaaaatatagtggccagtgggcggactaatcagtccattatggtccagtggcagccacccccagaaacagagcacaacggggtgttgcgtggatacatcctcaggcaagtgccctgtgattggccatctttaggccgccattagagttgagcgtcgatttcacagagggttgcaaactctaatgtctgtaagagccaaacaggaaccaaaggagtcaggccaggtgtgagatgttagggagtggtggagactgtggcaaactggagtgcacaggccaacgtgggcagccgtgcagagacattctgtgcatatctgaccataaatgacacacacaaaactggtgtcagggtagcattttggcaggagaatggagggggtattaggggttggaagcaaggtatattgttcaatgtgaagctttttttttttttttttttttttttttttttttttttttttttgatggagtttctctcttgttgcccaggctggagtgcagtggcacaatcttggctcaatgcaacttccgctgcctgggttcaagcaattctcctgcctcagcctcccgagtagctgggattacaggcatgtgccaccacacctggctaatttttgcatttttggtagagacagggtttcaccatggtgaccaagctggtctcaaactcctgacctcaggtgacctgtcctcctcagcctcccaatcctcagctgggattacaggcgtgaggcactgcacctggcctcattgtaggtcttttgattccatttaagttttcaaccaagggcatgtgttgttcaatacagtaattttaaattaagaataattaatttcatgtaattattagccagttgtcaccatgctggtatgttgcttgctatttccagaaatccaaagatctagctttgtacctgaaacctcccaacttttagatgttggaaatgaaatcaatatatttggaaacaaagggcagggctaacacacacttctgcaggccagatgtggctgaagggtagccagtgtgctgtctttgctttataaaggacagttaggcttctagaattattgggaacactgtatctgaacttgtctgtgtttgagagaagaaacctcctttgccaaaactgctaattttaaaattgcactgaacgcgatcattgcagtagcctgttgacacaagtaaaagcaaaagtaaagcagaattgcataataattattaaatctcttctaatagattgcaccactgtggacatatttgttcattttaccagtgatattgggacaagaacagtgggtatccgcttattcccttcctgggctcgttccaagtgtgtgatcagtaaacagtggctaacaaaggtcttcagcagacagatgtaatttcttagataaatgtgagaaattgggaaatgttgcatcttcagcttcattatccttgtgtatgaagggcaacgccttccctgtatatatgtgtatagccatccattcatcatttaatatgtgtttttctatgtgcctggactatttgcctgtcaaaaccaatttgccgctgtttacaagtttttcctccagcgtcgggattctcttctaaatgtaagccagaccgtgacccacctgaagtggtttaaatgggccatccccaggggtacacaaatagctccaatcaatagcaaggccccttttgtctcgaggctccaactgtccttcctcatttcaaagaagggggaagaggagcttgcagttctgtcccctcggggtgggggccgcaggctctggttcctgttgatcccctgggacagttcctaattgcctgaccacctccgctccagaaaacagccccgtgtccccgccgcctgcggccgagggctcctgtggcactgctgctcttgcccctgccttagccattacctctcattctgcacccatccactaatgagaataattggctgccctctgtacccagcagcacaggcctgtcatccctctgcctctgcctttcttcagcatgtgcaggaagagtttccttaggctgaagccgtcaagtaaggactttaaaagtcatcccacagaaccaggcccggggcacagagtttaataataaaacctctctgatgttacgaggccacttcggggactgcacatttctctgttttgtgggattactactgttaaaaggattttctgtgatggggtcagtagagttgggtgctggagatgagggcatcttctgtatttgcaggagcttaaatccagaaagctccaagatgagggtgcagtaccctaggcctgtgaatatcaaagttttcagaaatgaaagagccatgccaaagtgaatttgcttaaaaacatttccgcataatcctctggtctgcacatcagctctctgtttgcgagtgtgtatcctccagggcacagtctctgtgtcagatccgaggcacaatgcaaggaaagcaaagagaaataaatcacttccgtggctccagccataagaagtagttaggacgcgtgtgcagtaataaaatatttataataatagggagggtgtttctttgagaggagcataggggttatgtcctttataaacgttctcctgtttatttttgtataaaaaatcatcttgttctggctgagatggtctcctgggcaacatatcctaccagcaagaggaggctgccctgcacttccgttattgactgtgaccttcttagacatcctgtgactatcacaaaagcacccggagccactggtcagaatgggccaacgtgactgttccggaggggagcgcaggctctttggaagatgtaaattctgcagtttgttattcacagtgctgttaagagtggccccagagaagttgggtggctcatgcaggtgtagttccttataactcatagttatctctaccatacttctcggtagaagagcagtgtttaaaaatgtatatatatttagggagtgctttacaccttcacatctcttttacattcagtgtctcctttgactcttgcaacaagaatggaaatgctactgtcgtacccaccttaaagaggtggaaaccaaggctcagagaagtttggaattttcccaacaccacccagcttctgagtggccgttgagcaaagtcttccgatgctggttcctcagctcttccctggaatgtgcattgtgtagcgttgggtccacatgaggaatccttcttaaacggcatcctcattctgtcatagtgattacagatggtgcttggtgccagcatgcccaggctactcaggtgcatggtgtgggcacagagccagtttctaccttttcccaaatggctgtctcagtcccatttattttaagcgttcatcttttgtagatggtgaatgtaagtggaaatacctgtcacacaggtgaatccatgccaagcctttctcccagtggcccaccgccttgaggaccatcatgctacgtcggtgatctgaacaccacctgagaattgcacgtgtacttgcttggtgcaggtcgttcagtaaaggagtcagtgatggacacactaggaagccaaaacatggtttgataacttgactttcatttttgcccatcacggaataacgctgtcccttccctgagtctcccaccaggcaagcccagaggccacttgctcctttcaggcaagagacagaaggaggcccggtaccttcttgctactcaagggccatctgcttatcatcatttgttttctatcaaacaggccccaccaagtgtacatggtcggcggcaagagggaacgggagaatgctctcggaaactcctgatttttgtgaagaaccttgtgtgaccatttctcgatttcctcacttcattttcaagccctccttctcttgggaaagttgttttacattttagggcctgaatttctgggtttcttctctgcttcggtgtcagcagccttactgatgttccggtccacgcgtgtctgtctcagctccttccccttcgtgctcaggtgccctgcccgcgtgggaccacacaggtaatggacatggaatctgcagaaccacagagctcagagatcagcgtcctggaggagcctgaagatttccacatgccgtgaaaagccagcggatttgctgccactcaagtgtgggactgtgaggcaggagccacttctgggatagaaattagaggcttttggaagctgcaggatgacagggcagtcactcctactgggcatgcccctggctttacccagaggggctgatccaggaaagctcaataaattacctgagtcagttcagtgcattaacttctatagactgaatcatggagaaacatatgctaatcaaaataatacaatgcaaatcttctcacagtacacacagcaatttcctaatttatacaccctaagtcctgagttgtgtacattatctttttcataaacactactttaaatttccacctttagtatgctaagaacatagtacccaagcactcacagaggtcttctacaaagcaatttgtcatagttagtactggactagtattttagaaatttcaacaccttttcaaagccgctgattcttgttctgggatacacttggacaaacctgcaattcctaaatggagctctgtccctggacaccacaaggccgtgtgctgcttgcttctggaagtctccccacgtttcagactcacaagaggaaagtgtttctcaaactgatttacagcaactccccgatggaaatcatgtctggaatttttcgtcctaagtcactgtagtccctagacgagttacatgtaaaaagctgtaattttttcttaaccgttatgtagttgaaatgtcagttccattttgccttgagcttataatcactgtgagattagagcacacttttcaaaatcatcgagttgggaaatagtattgtttagggctgacctctcagctctgctcttgattatttacttccatttccccctaaccctgcggaataactgcgggtaaacaccgttcctgggtccagttatttccttatcgtgatgggcttccttcgtggcgcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggaggtaagcttgtctccaaaaccacgaggtggcgggatctttgccggggaatgggatttgcaaggtttgactggagtacgttagaaagaaaaacagagaatccagtcccctagggagcgtttacaagaaaattcatcacgtatttaatgggatctctccagctattcctcaatgaaaacagaaccgtagacaggagacaaataatattccaactgctttttcagtgactaaggaagtttctgtacacgccttttgacgggtgcatctagtcttgaaaagtctgtggaactggatttttctaaatggaatgattgtaggttttcacaggaaagctggctgtggagttctgtgtgatactgtgagtgtttttcaaagagcacgatgattattcacagttttatttttaacgacgtaacgtgattactggtaatcgaatttgcaacgtggtactttttttggttgtgcttttcagttatacaagcaaacaatctactaggtcaataaaaactgcccccgacccctggaaaaattgaccagacataaacgtcatgaagccagtggttcttaaatatccgtggtgagatccgggtgcggcgtggcaggctttccacagcatctggttcctccgctgttttctgaaagattcagatctcagccccaggaggagccagcattgggagatctcctccacatctgcatttcactgttactgctcttagcaggaataaacagaccctctcccaacacagcctcatttgtcctacagcagcccaaatccttgcccagggaagtaatttttctactgagtctaaaatcctttttcactctgcgatttatgccctcgcctgattcacaggtgtgattttatttgcttaggcatttttattgctaccagaccttgacctttttcagatgacaaggtttctgactgcccaattctctccccaaatcatgcctgagacctaatgttccttgatattacatgcttttattatcatcccgtattgactggctgtctgttgtcatctgtaagtccataaatcctcctttataaattaagtgcagtcagttctgcctgcacagcgactagaagaaatatttaaaatgcaggacagccaggaaggacctgtccatatgcaagtaattcttgattactcatttgaaaaggaaaatggctgaaaacctggacagttaacatttgctttaactggtctatttaataaattaacaataaacttagaaacacttaaaaagactcatattgctattagtaatcccttattactattaactgtgactgtttcattttatttccggtgcatttgagttctgcatggggcagagggaagtggatctccacctaattgagaagggctttgaggctttggactctggcttttattcagttggcagtggggaaccatgaaaggcttaagatctgtgagtgacatgagcaaaatgctgcattaggggcggaatctgtgcgtgggtgtgcagggaatgtaggaggcggggagcagagaatggcagcagggactctagagacaaaaaaaatgaattgatgagtgtcctctagctccaaaggctggcaatgagaagagatagggatgtaagtttaggtgggacgccattgttttcaaaacagctctcatggattccagggttgtgccttccagcaaccctgaaaacgaatgcagtttcggccccacaagcacctcccagtgccttctgtacaacagggctgggtataaaaacaggaacaggcccagtgcctcctgtacagtgggactgggtataaaaacaggaacagagcccagacccttcctcaaagtgcagacagtttataggatacagcagggcaagtttcattttcagacacctgttcataggaagctgaacattagctaactggaatttagttggtcagaaatcacacaggccacaaaggcagaaccagcactgacatccaggcttccaagacaagactgctgttctctgagtgacatcagctgcctctgacgtcagtaggacttgagatttcagaggagatttggcgagggactgtgcttagctagtgggctggggtgcagggttcccctaagatagtggcacagtgggtggggtcccgcctccatgtccaagtagtcttctggatggggaaattactaaattatgcattgctctgggaatgaactttttcccatatgtgatgagaacctgacttcgattggtccaaatctggttcatcatctatacttaaaaaaaaaaaaatgctcttcatgagtgaacgttagtggataatgctgcacgtgcagtttcccatctgcagctcggcttctgtagcagcaccatccttccctcacttgggtgtttgacattgggggttggtatacagagcccctcatgggtctcggagggcccagcagacacagtcgtaattcctgtcttcgtgtcttcttcatgtcttctgcctcggcactcctgggagcacccttatacagatgtggatggccctcccttgttcccttttaagcctggtgtggaaacacaggtggccccgtcctccctttgagggactcagccctccctctctggatgtctcggactcccgtgtgctcagtgggatggtaaatgcctctggggaatctccctggagcttgctgggattgggaaggtcatgtcatgcttttcttccagaccctgactccaaccctaaacctattcctgggccacgaggatgaacatctcaggcttgtgacagtctcggagacgccgggcaccacccacctgacccttctttgttcgagggacatgcttgagtcccaggataaattgggggctgataacagttactggccagagtgttaggacactatcccttggacgtggctggggtcaggcacgtggcaggcagcaggaagggtggtccatggcctgggggacatggctggcttggctggctgcacagccttgatgcctcagtgtagtcaaatgcacttatccctctgtgctattcaaggacctcccagccagccacgctgccgctgaacagaatgaagcgagcgtatgaattctgtcctgaatccacgttcccctctgtgacagtacattgctaggagatgacatcagaccaccagtctagaaagagctggggaggtgaagggaagacgggggcaatgcttgcctggctctggaggggaagatgcaatgaatgggacagaaagggatctgcctagaaggtggcacatgaggaagcagagtgacaagagggactgtgaatgcatcagggggacagtggtgggggcgcagtgagcgtgacgtttcacacacacgtgtatattcacacatctttctggatatgtgacccccagaaagagcccttcctgggagtccatccaggcctcactccatatttactactaatgtgccttcaagaagcacctgtgcccgttctgagcctgcagttttcatttgtgaaactgtggcatttacacctgtcctgactcaaagggcactgtgaagaggagatgagatactacgtgtgaaaaggctttcaaaacaaggagacatcacacacatgccagcactgtggctttgtctgtattcgtttttccactgtgatgaagagtgtctactagggtatttgaatgcttccataggggccattacactggaagagatctgggggtcatctccctactgacagtaacatcaaacagagacactcaagaattgatgtgagcacctgcagtttgtgcagagttgtgggaagggccctgaccccgagggtagggaagatatctggtgtgtcatcatccttggggacctgcagtctggccctggaggtgagactgtcattcatgaaataagagcaggaagtagaaaagaaatcagcctcactcatgcacggtcacccctcatctatccacagatcggggtactgggcgtgctttgaagagtcctcagtcagcacccagaggaacgggctatggacacgagggttgtgatccacgtggcggggacacctcagagtttgtggctatctgtgttgcttaggaatagtgtctggctgctagaaacagacccacagtgacaggagcttaaacaagatagagctgtgtttttacttttctcacatcagggggttgggcagtaggtggggcagtcatagcagcagctccgaggtcatcagagattcagggttctttgtctttttggctgccactttagcacgtgcctcaggtcacaagcctgctgctgcagtgccagccattgcgtccccactctagaaggcaacaaggagaaagcctcagggttgtgccttgggaacgagtatgcccacctttaaggaactttcttagaagttccatttgctgctgactctgcttacaattcctggaattctctccttgtggcagaggctggcaacgtggccttccagctgggcacatatctgtcccttgttaaggaaggaaggggaagctcacagcttctgcctcactttctaagtgagatgaaatctgacaatgggctcctggcttgcctcacacagaatgaaaactgcaaaagcacaggtccttcaggccatgacttcccacccatcccctgagggctcctcagcctcaggcccccagctccatggggctgtttgggcattaagtgctaaatgcttatttgctgctgggagccccacttaggggcttgaagtacccccagctattagcactgattgtcaaggcagcctaggggcttgagcaggtccttgaagctgaaaagggagtaattaaaacgcctgtaaactgaaagggaaagcataactcataaaattaattatttgtcggcataatttgggaaattattggaatgtctacaaagagaattcgacagcatgtcagagagcatgcagaaggcaggaaatgcccagccaggagaagaaggaagccctaggccagccagcctcatttctcctcctcccttcagtgagtggcagcttgaggtatccggggaaatgagatgtaattcatcttgactttaataaggcccttggattgagctcctcctgagaaagtatccgaatgcccgggaaagatggtgcagcgtgcgctaccattaggcgggtgtggaacttgctaggctgccgtctcaaagagaactcagcagtgacacagcatatgcctgggctgagggagggaagggcatgcaggctgccctggttggcacaagcagcaggcagggagcaatggagaagctgtctgctgcagggggaggtagcagctcattcttctagagcatacatttttggtctcaaatgtgtttccttccaggcaactccttaaggaagatcagcagtatgtagtgagcacagtgcgatgttgaccccaccactcactggccacactcctcgtttttcttttctttctttctttctttttttttttttttgagacagagtcttgctctgtctcccaggctggagtgcagtggcgcgatctcggctcactgcaagctccacctcctgggttcacgccgttctcctgcctcagcctcccaagtagctgggaccacaggcgcccgccaacatgccccgctaattttttttgtattttattagagacggggtttcgccgtgttacccaggatggtctcgatctcctgacctcgtgatccgcctgcctcggcctcccaaagtgctgggattacaggtgtgagccaacacgcccggcccttgtttttcttttcaatcccatttatggctcagatatatttacaatgcatggtttgtccactccagttcttcgcaagctctcggcatgggctagcaccttggacacatggggattacttaatataaactttctaactttcctgacttttcttatcccccttcatccaccatcccccattatcttgtcggccaatcccatttaatagattttattaacggtgactccatgaccttttcagctcaaggcattttaaaatgggacatattaacttacaaattgagcagcaaagctctaatacagtttcagccaagtgaactttctgaggggtgagaggaaaggttggtgctctcacagaagctgtggcctgaaactccaacagactcagttccgcatatcaaatttccatgatgattacccacgatgaaatggaaaataactgaaatttactcgagaattttaaatttaaataaccgaaatggactcagaaatcaatacgcttttggtgtcgagtggaaaaaattccgcggagtgtaagttgtgtataaccgagtgcccagtataattagaaacatttttcttactgccagtgtttacttcagcaactttctaatagtgtagcttgggagggagagtactatagtcatttgaagcaatcagtagttcatatcgatgctgactcgctgtttggctcacaaattcagtttttgttagaaattgttcaaataatgatgaaagacacaggaagaaagaatgtggctgtgaagttttcaggtgaacctgagtgtggaacactggacactgccaggatataaaatgtaatcgattacagttttgtcctaaaacaagcctgtatggattagcaaactccttctatacattttttgaattcatccattaagacgcagatgttggtttttctagaaggggtccagagacaaattatgctataaatcatcattctgagcacaccaagattttcctttttttctggttttatttctttatcatttttcttcttgtaacaggtatatttgtgctgtaatgatttattctggtttcagaacattaccttataatgaaagagaaatatttcatattttaaaagaaatggaaaaaacatttggttatccacatttctaaaacattagtaaaagctcctaaatgttcacttgggctttgaaaggttttctaaagtaaggattataaatgagcactctgtttgcaagccccattcttatctcctcttgggaaattctcaatgtggcattaaatgacattgcacaaaagatttgtttctcaagccctacaagactttctagacctcaggctgtacctgcagaataggataatgttccagattctcccagcgttgcctaaaacactaagtaaaaactgaacaaaatagatatggaatattccattaggggtgggcttcctttggtcttttagaacctacaggaagacaaaggacaggaagctcatgctttaggggaagccactgtgtaccagccttcaccatgctgtgccacgtccttacattcactgtcttactccattcatccctgggggtcacataagataagcatcatatccctattggacagaggcaaagatggaatctcagtgaggtaactcactttcccaaggtgatatagctggacaatgctgagaaatgccggagccgaaacttaagtctgctgggctcccaagcccaggctatcatctgccattactacagtttatgttttttgtttttgtttttgtttttcattctgtgtatatcagccctggtgaaaaatgacttccagattcccacagccgcattatgtggaatagaaaagacatgggcgtgcttctcactctgccgccgtagagggtgggtttgcagtggtttctgagcactttggactgcggtgcacaatgagaactctattttgcattcacacacacacacacacacacacacacacacacaaacagagcatccatggaacaatagtgactctcccagtgtatgtgtactttggtattttctgttctattccattctgtttcattctttaaaacaatgctgctgtgaccacggaattgatttccctatccacgagtgtatttgtgacctacagtttgaaaaatcctgaattccagcaatacagcaacactgtttggtttgactgattcttgcctccctttcggaaaaagcttccgccgaacagaggattcatcagggtctcggctatgaagcctgtcttatcctttcaactgtaaagacagacgggtctgagtgagggcgtgagcagggccgccagccgaggcacatagcggaggactggggtggagcagggcaggtagggtttagcatctgtatcggtgcagatcacctctgtgcacacagagaaggggttcctgggacttacccttcacctgccgctagaggacatgtggaaaaataaaccaatctaagttactgtgagcatcaccttattttgtgattcgcaggcctgtctttcctgctagcctaggaaccctgtgagggcaggggctgtgtctgatttgtctttttcatatctgtatccccatatccaagcacaatgcctgacctataagtaaacaaagcataaaatagatgtctgattgaaaacacagggcttattgttcctgtttcaacacccagtgctgcaccactttaatctccatcttcagcaccatagcctgccttctgccctgactcttgctgtctcgaagtctcggaagaaagcagtcctgagccctgtcacatgtgagttaggccttcctgtctttctgccttgtgatgtccaacagcaacccttcctgggtgccgcccacactgagcctggctttgctcaggagcctaaatgcagaatctttcctcctccccctcccctgctggaaatgctgaatccgggactgcagcccagaaggcgcatggggaaattaggtccacgaacgcgtccccagcgttggggaggtatgccactcagcaccctggacacgccaggccgcagcgctggtcttccacagtccccatgctgtatggaaaaggccccttgccccacggctggagaggggagctggtcgtgggaagagtggaagagaaaccacaaacatgcaattttcagatgcggagaatgcagagacagggcatgggaagtgggggtcgggagaggaagaggaagagacaccaagtcggcaggagcccaagcgagtggccagagcttccaccctcggtggccttgggcccatgttttagaagctcagcgtttggcatgggcgaagatatattttaggaatgaaactggtattttgtgaatagaaataacatcttgttcctaactgacttcagagtcagacgactggcttcacgagggcccggtgtgcagacagcctgccagggcctgcgggctctccccacgtgctgtgcccccaccccagcccaaacactggccccaaatgcttctcttcaatgcctggcaagtaaagatttggaaaaaaaaataagttcagaaaggaacacacaaaactttttaagtgttaaagtattttcttctgaaggccatcagaaaagaaacttgagcttatttgtcaaaggtttgttaacctaataatgccgtagaaatgtttaatgcagtgagaaccttcaggtctatcaaaactgcaagcaccataacaacgcgagaactcagccgtggcccataacaatctggaattaacgataacacccggcacacaaacggcaatatgtacacccacccagcggtgtgcggccggtgactctaccaggtaacgaactcaccgctccctggtttcaaaggcgtatacatttaattctatgtggtaacctggagaaatggacacctgtgaatccctgctgtgttctggatagatgcatcagtcccttatagtttaaaccatgtacatttgggatcatgaaaaacggtgtgtgctgttgtgcaggacgtgaagatttgtgcttcttgcatcgtggggtagaagcagctcccccactggctgctcggctcccagcccctggcttgctagaggagatcggagccagcaagtggtccctgaatggtccagtgaaggctgccgagcacccaggagaactgatactgcacctgagggtcatggacgatgaaatttcactgtgtagagaaactgagatttcacggtttatgtgtaacagggaaggtggtgttgctttagtaaatagaactgggcatgttagaatatcggcaagtgcactctaatttcctcctgtgccaaatccagctgattttacagcattctcagtgggctccttagcatgtgtaggtggggtttgcacagtcccgtagggatactaagtaggatgtagaaattgctcattccttactgcagaggcctggatattcacatccacctggcccaggagggcctatgaattgctctcccagcacctcctaatatcagtttattaattttatttgacatgttgcaaatctccaaaacatcctagagctccatgcttagcatgagtttcctcggattaaccatcattttctactatttctccgtttatgtagatggaagagaagatgaatagtaataatcttttctcaggggtgttgcaaataagctttatattaatttcatcacattatatgacttaaatatcaaaaataaaaatgtgtgtctctctcttcagcagcagggaaaatacctgctggacgtagtcacagactctgtgggctttaactggcagcaaacggtcctggtagaggagaggagaagggggagaaggggcttgtgggaacgagagtaggggctttctatcaaccaattaattaggatctagatagaataaaagcaacaagcaggggaagaatggaggaggggagggagagagggaagaaagaaaggagcagagaggaaggtaggcaattaggtaagaaggggaggaggaaggaagggaggagaaaataagtagaaaagcaaattgacagtggtggttctcagagatggtctgtggacccacagaatcaacatctcctaggaacttgttagaaatacaaattctcgggccttactccagacccactgaatcagaaactcttaccatatgtgtttcgacatgccctccaggtgactctaacacccactctaatttaggaaccttctttaggcattgataggtagaagaatgtaataccaaggactaataaccatgagccccaccagctgtcatagcagagggcttgtacccacggaggatcagtccaggctcctggagagaaacaataagcaacagtccccgtgaaccacagcatgtgacatgtgacatcaccacgtgtgcaggcaaatctctcagaagaaacctcaactgtgtctcaggaaactctggtggttgggtgggaggctggagtctccttaaaataaaggtcatgactttgggaaaaaggtggatatgggtgatgacacattgtctacataagaggactgagctgttgggaccaaggtgaaccagtgaaaacacacgtttggaggaggctagaatttcataacactttatgtcccacatttccacctctagctctctggaggacaggctgggaaggtctcattggccacactgacttccagtcaagtatcccttttcttctggttttgatcggctccctgtcaagatgaatgagatttttgttaaacacgggattttgttgtgacttgggatggggttcatctcaaaaaggagaggaagagcccattcagcggaaaacccattggaagatgaggagtggagaggaaatacttggacggagctctgcaacacttgatggggacaggactccaggttcatgtaaaaggaagacgccaagagaagcacaaccctgtaattcctgtaattcccaggaagccatcaccaggggtcacgtcgggtgtgctcaaagtgcggcacattctaccaaccccgtttgcttttccgaggggggtgggggtcactgaattgatagaccttttccgaggtgggtgggggtcactgaattgatagaccttttccgaggggggtgggggtcactgaattgatagacctaaataccatattcatcctgtagcttgattttctttcttttattctttctttttttttttttttgtgaagaagtctcactctgtcatccaggctggagtgcagtggcacaatctcagctcactgcatcatccacttcttgggtaaagcaattcttgtgcctcagcctcctgagtagctgggattatgggcacgtgccaccacacctggctaatttttgtatttttagtggagacaggatttcaccatgttgggcaggctggtcttgaacttttgacctcaagtaatctgcccacctgggcctccgaaagtgctgagattacaggtgttagccactatgccctgccgattttctttcattcactcattcattcattcattcattcattcagtaagcactttgtagataagatgagaaatatggattgggtaataggtcattagatggactcccactcacatcacccaagcagggtggggattgagctatgcccaaagagtgtgatttacttgatcagccaccacttggagggtgacctcaacaaactctagcatgctgggcttctcctgggcagtaccgtctgtgacttggagcaaatggagatggcatccctgtcaaatatgcaggtgtcacagctaagggggtaattcatcgattctgccccagaatcagaaatcaaaaataaattgctttgttagattggtggttggaatcaacacactgaaatgtagaaaggataagccaacatgctgcactcggatacaacaaccactaacgtggcagcaggatggggagacgtgacttgtcaccagttataacacttggggtttacacccagagagagctgtgaccgtaacttaaactctctgtggatgacaggtttccagatcgaggtaaatggcagcaccatacaaccctgtactggctagatgcgcgtcaagcatcggctccgggtgcctggccaccaggggaagcaggaaaattcaggcccctctgaggagcagagccagaggggcagtgcttcatctgtctcatcgtgtgagccacacagagagaaccaaggcatgtgttcctcctatcatagtcaagtccagttagatatctttgtgacattcaaatagtgtgacagctatatatgtgtacgaaaacagcttacgcagaagacagaggggaaccaatgggcagaagttgctcaaagaaagatttcagttcagcataagggaaatcctccttatgatgtacaccctgcacgagttgacgtaaggagcaggaaggttgggtccaagaagttttgctggtggcagttgacaggtcgcaggcttgggtgaggtgacaggactcctgcccagcaagttggcacatgccgtgacctaggagggcccctggggcaccttctcctccagtctgcataactctatctggacatcatcaacgggcttttcatacgcgccttggtgctatgaagcttcacacaagaagcgttcggcaccaacattcaggtgattttaatttcatataacaaaaccatgatgctgaatggagcgtatgtattccagcttgcgtccatgccttggcatgttcccaggttgcactagccttcccgctgtgtttcatctggcaattatcacttatatttaaagctttggcccaggaactgtctcctccgtagggcctcctttaaagaattccatgctgacctgcactgtagcactattacacagaagtgtaaatgtctgcttcccctactacactatgagctccattaaggcagagacatcgaacttagatttgttacataaacacaaagaaaggaccaggtttcataacagtaggcccccatacatacacattcacatacatgcgcaaacagagacaagtatacatatacatgtatacatacacatctgcatctatatatacacatgcacacacatgcatgtggacacgtatatatacatggacacagataagtctatatacacatatttaagtatacatagatatgttcttgtacatgtatatatacacgtacatctgtacatcctcacacatacacatatgcatgcagttatcagataaaatcggcttctgtgtaattgaaaatctaaagccaaaataattatttcagcaaattataatatttataaattgaacttgtatattttgccatattattagtctgtaatcttttatcacagaatttttagggaggaaaggaaaagtttactagccaatggtaatgttactcataacagagaatcaatagattgtatccagagaaagagaggactaaggttctatgtaaacgtctgaattatgtgtgtataaacattagagcaaaagtacaaaaaccttcccgattactaaaacatatcaaaaaagagagaaaacagaccaaataaagacacacacacttacatatgtcaagaagtgtacatgtaattatatgtatgtagagaaatatatgtagatatagcaactatctacatataaatatatgtagatatagcaaatatatgtagctatatgacagaagtgaagtgaaatttattgattatatcaataaatatactggacttaattagctttataaaaataaataacatttccccagcactttgggaggccgaggtgggtggatcacctgaggtcaagagttctagaccagcctggccaacatggtgaaactctgtctctactgaaaatacaaaaattagccgggcatggtggtgcacgcctataatcccagctactcaggaggctgagtcaggagaatcgcttgaacctgagaggcagaggttgcagtgagttgagatagcgccactgcactccagcctgggtgacagagtgagactctgcctcaaaaaaaaaaaaaaaaaagtacatagatagatagatcgatcgatcgatcatgtcctaggccacagaaaacccaaacaggtccaaagaatgcagacaaatgcaccagataagaaagttgcggattagttttatcttaagagtgttgatgggaaaagctaaaatggtaaaaattatcaaaatccaacagtacatttaaaacagtagatcatattcaagtgggatttattccaagaatgcagttttgatatttgccaatattcaatgcccatctggagtacaagcatatgataaaatagaaatgtattgacatttatttgatacggtaaactgtgcatgtacctcaagctctcaaatctgcattccccatctacttgactgggaaaccctacaggcattcctgctgaaggcagaagcgtaaggtagtccacagtctcctctgctctttaatattgaaatcgacacatttgccacagctgtagacaagagaaagcaaggcgaggtataaatccccaaaaggaagtgattaaactatctttatttgcagataataatatatgatatctggaaactactatgagcaataaagaatttagcaaactagcaagctataaaatcagcatgaaaaaacaaaccgacttcatatgcacaagcaaaacatagcttgaagttgtaatcagagagaagatcccatttacaataacagaataacattagaaaagaaaagaaagctggggataaacttaagaaatagcaaacacatacgaagaaaagtacaaatgctgctggaagttactagagaaggtgtaaacaaacggaccgtgtttttgaacaggaagactcaacatcacagggaagttagtgctccttgtgtgaatttagaattgtcacatgatccccaataaaataataacagatttttttctggagctagaaaagttaatttaaaattcattcataaaaataaatgagcaaaaatagtcaggaaacttctgaaataaaagtaatgagggtggactagtctcctttaggtattaaaacatattgtaaagtgctgtaactaaaatggtgtgtctattggtggatgactagaagatgtccggaacagaacagaaagcccagaaatggaccccattcgatatggcaatttagtatataataaaaggacatcttgaataactgaataaaatagactttttgataagcattattgaaataagtggatacctatatggaaaaaatacaaaactgtatccattccctacccccatatacaaggatacattccaagtggatcggagatatcaatattaaaaatatgaaactgtacaagtactagaataaaacactagttttagtctctctaacctggaagtggggaaaacttgtctaacaatgactcaaaatctcgaagcaataatgaaaagattgatgaactgactatttagaagctttaaaaagctaaaatattccatatgcaaaaaaatacaatgagcaaaggaaaacaagacaaatagcaaattgggggaaatctttgcagtttatatcccagagaaatggttaatatctctatattaagagctctaaaacagagaagaagaagaaaattagaagaaaaatgggcaagctctatgaaacaagagttcacagaagtgcaaatggcccataaccacaggagaatacgctcaaccttatcaaggtaacacataaaaagtgatggtacacagacacacagagaacaatgtgataaaaatgcaaaagtctgacaatactctgatgaggctcgggggagggggaagaggcattgctgctaggaatgcaatgatacaacccctaattaattcaatccaaacacatcagtgggtgctagaactagtgggagaagtttgatgaggaacaggatagactcctcacaaagtatgtatacatcacaaaggaaaaaaaacggagtaactcgaccctggagaaacctggcagtgagtggttgcagttagcaccaccagtaatggggcacctcagaactgtgtaccactggataggatgcgatgaaaagaacacagcctcgcctctgtgctattcgtgcctacgatgcaagcctgaatcaagttaaaaagaaacatcagatggactcaaactaggaacatattgcacaagaaattggacggcagcctccaaaagtgacaaggtcatgaaagtcaagaactactccagattgaagaagacgaaagagacatgattcctaaatgcagcatacgatcaaaattggattctgtcaccacagaagacgttgtgggaaaacaggagaaaccgtagattagatggcagtcatgtgtcaatgccgacgtcccggttttgatgccaatattgtggttacctggtgagtgttcttggaagtacatactccagtatttgggggtgatgggcctcatgttagcagctcactctcaaacagtttttaatgtctttatacaatttgaaattctttgtaaatttgaaatatttcaaaatgaaaattatctttggcgtttaaaaatgtttctcattctttttcatttaaaacacaaactgatgcagcccctgaagcaggacaagttagcagtaactaattaacctgtttaccttctcactcacaaactcgacttttaggagtttattccaaaaatgaacttgcagacaaatgaaaagatacaggtacaagcctattcgctgcaacaccacttgttatagcaaaagactggaatctaccaaaatgcccatcattaagagaccgactgagtagaccatggtatatccacaagatggcatattatatatcataacagaaagaggacgaattcgagaactagagctatggggaaaaagaaggtaccaaaatagaaatcagcattctctgaatatatttgcttatagaattggctttgaaagcatgtaaatatattttatctattcatagcactaaattaattttttttggagacggagtcttgctctgttgcccaggctggagtgcagtggcacagtcttggctcaccgcaacttccacctcccgggttcaagcaattctcctgccttagcctcccgagtagctgggattacaagcacgtaccaccatgcccagctatttttttttttcttatctttagtagagatggggtttcaccatgttggtgaggctggtcttgaactcctgacctcaagcaatccatccaccttggcctctcaaagtgctgggattacaggtgtgtgccaccatgcccagccagcactaaattaatttttaagcctttggaaaagaaattctaagaaattgaaggcaaaattaagcaaagggacagaattgtatactgagttggtggcataacagtatggaaagtaactgtttcacataactttgaaagatggaaatttgtacatcctagtgggatgtactctaaggacaaagaaaaaaagattttcaactgttttcagccattggaatgttggtgggagtggcatggcagatttgtgtctttaagacagttgcatgagtattgtggggctaaagcaactaagtgattatgttgatgtctttgggaaatgagattttcagcccagtcttaactttaagtctgaattgggactataatgattttaccttttaaaacttaacctagtggcactgagcttcctagtaacagaaaaatagcaagtttcttggataaacacatgattgcaggtcagaagcagataatgtgtaagatgagcctggaacatctcatcattccaagaagcaaagacggtatgctatcaactatcaacatggccttgtcaaaaaaactcttaggccaacttgaagaggctcctgctagttaaagatgggaaaatttacaaatccataataataataataactgcaatggactgaaatgcttcaagtacatttcaatccgtaactattcaatgctgaatttgtatgaaacttccaagtcaaaaatctcttttaagatttttagtaagaaacttgagcttcatcggtgaacataacattttctacaccggattttattcttgtgatgacttcattcaagacttttaatgataacctcttcaaatatttgaaagccgcaattgacaagaaagcttctgccaaagtaggaggtcacaattgctgggaaattatttattgctttttccttagttgagagcaacttttttcttgacattaactagaattcagataattaagtctctttaaattatactataagggtacagtgtttctttaggtcgacagttcttctttttatttctttgacaaaagtaatgaatggttttgtgatcgtgtaaatggatttggaatctgatcaaatgtttttaatatcaggtatttcaaaataatgggcatttctgtagacctacatggatgccgctctaccagtcttcattatttttctttagggcataaacactgacttctttaggattacaaaactgattacatctcacagtttttaacaccgtaacatagttgaaattttgctttgaatccatacattttacacgtacacgttagtatatgccatggtctaaatattagtgtccctccaaaatgtgtgtgaaaattgtaacccccaggagatggtgttaggagatggtgcctttgaggggattagattgtgagggctggttgggattagcacccttatgaaagagacctctgagagctagctagtcccttctgtcatatgagattacagttagaaggcaccatctctaagaaaacaggccctcaccagacactgaatctgcctcagtcttggccatcccagcttgcagaactgtgagaaataaatgtttgttgtttatgtgctacacagtctatgatatttttgttatagcagcctgaactaagttggtatacttttcacaggttcttgcagctgtctattgcattcactcaggtgcccaaagacgtcatttaagaggccgtttttgataccaatatcctctgctttaaccaatcttcaaagtgagaccccttcaccaaaagtaataacaatgatgatgataacgatgcattgttcatagattcttgcaaaactctttggacagccaatgcttgtcaatttgaaattgcaataggaaatttaaacgtttctgcttttgaataatattgtttgaagatgcatggatgacaggtcagatgaccaaagacgaacttcatctagaagatcattaaatcgaacaagcttcgactgcacactgggagaactgatgttagtaacaacacttgatgtgtagcgtgagtctgaatctctcaaaagaaattcttgggctaggcatggtggctcattacctgtaatcccaatactttgggaggatgaggtggggggatcagtggaagccaggggcttgagaccagcttgggccgcatagtgagacccatctctacaaaaaatgcaaaaaattagctgattgtgatgactcatctgtaattgcagctactcgggaggctgagttgggaggatcgcctgagcctgggaggttgaggttgctgcagtgggccatgattgaaacattgcatcccagcttgggcgacagtgcaagaccacatctcaaaaataaaaataaaatagcttcttttgtcaaaaatgacattctgattccatatttttcacaaagcaaaaagcaagtgggaccatagcatcttggattttattagacgtgccattctgataacatcacttaatgaggaatacagctttataggccatcttttacctagagaccttctctgcgaatacaacaatggatttcttgattcccaggctcttcagattgaattttgctataaagtgtttatacctttttaccatcattggtatccaaaacttataatttttttctctattatgtattccaaagtgtttgtgtaagctttgaccatttcatccccagcagtttgtctggtatatggtagatactgtagtgctgccacccaggtcggttcttcagggtgacacagctgtccccagtgctggcacataggctgcccagctcacagctgtgaccttcactgagaactgcctgaccaaggtgacacccctcccatgggtcatcctgtggctaacggcgccacaggaaagcccagtcccctttgaatcagttgaggacaacttaagacccctctattccagagctccccagaggatcgactgaggcctcagctactgccatcctgtgggacagcttctccttctgccctgtcctggcctccccacttcctggcagatgtctctgttgagttccactgaaacttaaactccaaactcttcacgcccagagtctatgaccggggcaaacaattgaagacagggaatttttttttttgtaccttaaatagtgttcaaagcatttattttgagggattcaaactcatgccatacaccaagtgccgttactaacatcagcacttatcaatctgcagtggaagcttgtttgatgtaataatcctctagactgggtttctctgggtcatttgacctgtcatccatgcatcttctaatggtattattcgaaagcggtacttttcttatttcctgtgcttcactggtcccaaacatgttgctgacagtttctaatgcaccttggcaaagtgagtgattctgcaattgcaggaggaattttggctttggctgttaaatgcaggacattggaactagcatcttgtattcagtctgacacagttgtggtccactcatcaatactcccacttcttattgtgtaactgcagacaattttcccagttctgatctttttctgtatgagatcaatgctttagggaaaggtgctggcataatttgcctgatgtcattgcatcttctgattcctttttcattaaatacgacattgagacagaagaagacaggattattggaaaatgcaaatctgaatttgagatcattttcattataatttcctgagtagcaactttttttaccactctacttggtacacttgatgactttctttaattaaaaaacgtaaggacaaaaaaccaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttaatgggttcagcacaccaacatggcacatgtatacatatgtaactaaccagcacgttgtgcacatgtaccggaaaacttaaagtataataaaaaaaaaagtttcttattatgatgggaaaatatctctctataaatatgcaacagtattaaaaatatcaacctaagtaattttactaaatatatacatatttaaatataaaagtatataaagtggcctgtaggccttaatggcttcaaaaattaacttttcaagatattttgattgcatacatcctcaagaatgtttcaaaataaatcaagttgaaaaattcaaaaagcaaagcttgcattaaccaaaatgagcaatattgacattcctttttatttgattggacaattaaagttctgaaaaactcatgaatataaatgtcagtgatgtcatctctgatccaaaatattttgaaaactcaattatttgaagatataaaaccctacagtcctctttactgagttgatttaattatggaacttattataacatctttaaaaatctgtaaaaacagtaatttattttgagattccatcagtaatcagatcttgctaaatttacatcatcactagccagaaacgaagggaagggggtgggggagaagaaaattttaaaaatcatttttgttttaataaggaacacctaataccagataataattataaacataatcatacgttttacttagtcacataggtaaaaatactagcaaattaattgaataagaagcgcccccacatgctgagcatgttactgaaccaaactgggtttgtctgtccctgcatgagaggaagacgctgaagcactgggtttttgcagcaaaaaagctttattgaatgtcaagtggtgaggagcaggaggaaagactcaaatctgtctcaccacactgggggctgtaccgggctttataagcatagggtaatgaggcgtgttctgattggatcttgcagtggggtaacgccagagctgaatctgattggatcctgcttcagctttgccatgtccatttcttaatccagtccctgctcctctgcctgagcacttaggttcccccaccgtggttgcatgcttggttcatctgagtgtgctcagagtctgtagtcttcaacccgggggtccgtggcaactgaaaaacaactcacaacctacttacacacaagtcgaaccacattgtgaagcggcatttttgtctagggtaatacccaaagtttgttgtctcacgctgacgaaatcaaggacccggacacacaaggagtgaggttaagagtggaggtttaataggcgaaagagagaagagctctctcctgcagaggggtccggagtgggtttttccagtccgccacaaaatgcaaaggattttacagatgagctggaggaggcaatgtctgatttacatagggcatgaaagattggtcagaccaggtgtgccatttgcataaggcacaaaaaaccaggactggatgcgccatttgcatagcctccaaaaatctggccacccacaccctaatcttttattatgcggatgggttatctcccccgctggtgccttgttgcctgcatttttactgtacacgtggtgacaaagaaaacggaagatggagcctccatgttgaatgtgtctggccctcaggtagcccttttctgttggcacagctgccggcattcacctgtgcaagtttctagcttgcttatctatgtctgcagctcagtttttcaggctgctctttgttagaaaagaaatgatttgggagctgttttctgttaaaagggaagccttgccaaagactctcttaccctcactatctgcctaaataatttctttctagctcctgtatcaattggtcctgtgcctggtacagacaaacaaattcacagatgagaaacaacctgcaagtgaaataaaacagcttgataagaggggtccatgggggtgtcagggaagtgccgtgtggctcagccaacctgtgcctttctgcagcagatcctctcaagagagttaccgggttcagaaagtttacaggaaccacatgcatagttttgttttacttttttttttttttggagtactttcagattcataggacagttgagtagaaagttaaaagagttttgatatactctctgcccaacatgtacaaagcctctcccactatcagcatcccccaccagagtggtacctttcttatgagcagtgaacctaccttgatacatcactacccaaaatccatagtttacgtgagggttcacgcttggcactgtgcattctgtgggctttgagaagcatatggtgacatgtatcccccgttatagcctacagaagagtttccttgccctcaaaacccccatgctcctcctgttcacccctcctgactgccgacccccagcagccactggtccttttgctgtctccatagtttgaccttttccaaaatgtcatatgtagttggaatcacacaacacatggcttttccagaatgacatctttcactgaggaatgtttaatgcatgcgtgtcgtgaaaacacagcatatatatagtgaaaacagcatgaaatgtaacttcaacagctgcaattttttttttcttttttgtgacggagtctcgctcccttgccaggctggagtgcagtggtgagatctcggctcactgcaacctccgcctcccaggttcgagcaatactcctgcctcatcctcctgagtagctgggactacaggcccgcgccaccacgcccagctaatttttgtgtttttagtagaggtggggtttcatcatgttggcccggatggtctctatctcttgacctcgtgatccacccaccttggcctcccaaagtgctgggattacaggcatgaaccaccgtgcccggccaacagttgcaaatgtttgaatggctgtaaacggtggtttatggctacaaaaactaacagatatccctgtctctgggtccctgtgtaacctatccgaggcacagtgagagaccactgcactgtcccacctccttcttccccatccactcccagaaatcctctcttcaggtaggagaaactgctactctctgatccaggtttcacatatttccgtgggatataaaacccctagtgcctgaaactgctcttctggtttctcctttcacctgtgattattccctgagtgtcgggggcttcaggacagaagactttgtcattggctgtgagcatcaagacagtgtccaatgggtttaggctgagagccagctcagccaggtgcctgcgtggggggaattatccagtgaaaagatatttgtctgctcagtgaaaaccagaaaggagcataacacctgtcacgttaccagcctgcctccaggcctgccattggaggcacagcaagggtctaatgctaatcatccggggaggaagtgtcccttgaggcttagtctgagcagcgggaggccacgctgcacacttgaaaccccttttgccttgacttttctgcagcatagttggactaagcccttgtcgttggcttaagaaggggcagggttatgtaaccctcaataattaagacctttccagccataaccactcttttattttcaacactgtcaagaaggatttgccggctgtaactctttctcgcttgagggcatttttaattccattgtccacaaatttctgagtcatttctgatggcggtaatcaggacaaagagaagccgaagacctgggaataaaagcaaggttggcgattttttgaattaaacctagggtattgagagaaaggaaactgaggctttagaacctcccttgtcctgtgactggggaaggagagtgtgtgcccacaggtcaggctccgaatctgacaccagggagcccaggtagagtgagtgtcacagccaggggctcaggtagagtgagtgtcacagccagagacccaggtagagtgagtatcatagccaggagctcaagtagagtgagtgtcacagccaggggcccaggtagagtgagtgtcacagccaggggctcaggtagagtgagtgtcacagccaggggcccaggtagagtgagtgtcacagccaggggcccaggtagagtgagtcacagccgggggcccaggtagagtgagtgtcacagccagggacccaggcagagtgagtgtcacagccagggactcaggcagagtgagtgtcacagccaggggctcaggtagagtgagtgtcacagccagggcctcaggtagaatgagtgtcacagccaggggctcaggtagagtgagtgtgagagctcgtgattttaggtagcccacataatgagaagggaggggaaaatgccttgttaaatgggtgaactcaggaatttgtttctctgtaaacatggtgtgccccagagaggcactgcctccaggatgcaggaccagaacttgacgtgaggattgtgctgcagccacgcaaaggtacagacgtcctcttgaatctgcaggaaatgactacttatttaaattatgcaaatttttttgttgcatatgatcctcatagccttactttagagaatttaacaacatttgatatttggtattctggcattcctgagtcagtaattgggcttcgtgaaaccccagagctaaacctaccgagaatgagatgccgtcctcaaccccagaggttgtgggttctaagagaaaacgtcacaacaaatgttggtcttttcccaatagctcctggcgtttattctttcttttcccttttcttcctttttctccttcctcctcttgtgttttcttttctttctttcagcagagattgttctggtcatctattgctgcctaactgactaccccaaaacttagagattaaaagcaacacctgtttatatgtcatgattttgcgggtcaggagttggagcagggcttggatatgtgaccgtctgtgcctctcattcagttgggaagatggcttcgtgcacacgttggcgccatggctaggaaagcggaaaggctggctccctgggctgtccactgggcagctgcccctggcctcgccagcctgcagcctcaggatccccacactcctaccgctgctcagggctcccggaaggcagcagaagctgctagtttattaggacctggatcatactctattggtcaagcagtctcagagcctacattgaagggtttcagacatagacaccacctcttcatgggaaaagtatcaaagaatatgcagcattttgctttgctttatttttttttagggacagggccttactctgttgcttggagtgcagtggcaggagcatagctcacggtaacctcaaactcctgggctcaaaccatcctcccacctcagcctcccaagtagctaggactacaggtgcatgccaccatgcctggctactttttttacttttgtagagacagattatctcaccctgttgcccaggctggtctcaaactcctgggctcaagcgatcctcccaccccagactcccaaagtgttgggattacaggcatcagtcaccatgccctgcctgcagcatgtttgaaaagtgagatttattgtggtttcataatttacatacagtaaaactcaccctttctagagtacagttatatatacattttcacaaacatctttagcccacattcaccagcgtgacggagatatgactatttctgtcacctcccccaaaagtctttgtgcttttatattcacccctttacccccaccccagcacttggcaagcactgctgttttttcttcttatatctttgcctatttcagaacatcatataaatggagcatgcagtgtgcagtcttcagaacctggcttccttcccttagtgtcatgcatttgagattcacctgtgcgttcatgcgtataagtattttgttcccttctactactgagcagcatcccattccatagacacactacagtttgtttcccatccattggtttaaaaacatttaggatgtttgcagtttggggtgattattaaagctgctatgaatatcacatatagattttatttatttatttatttagagacagggtctcactctgtgcccaggctggagtgcagtggtgtaatcacagctcactgcagcctcaacctcctgagctctagtgatccccccatctcagcctcccaagtagctgggactataggtgtgtgccatcatgcccagctacttttttgatttttttttgtagggacggggtctctctgtgttacccagactggtttcaacctcctgggctcaagcgatcctcccacctcggcctcccaaaatgctgggattacaagtgtgagccactatgccccgcttcatgtagatttttatgtgaacttttacatgtcttgtgcacagttacccgggggcaggattaccgggtcacgtggctcgcgcatgtttaacttcgtaagaaagcaccaaacggtcccaccaggtggccgtgccatgggcatccgcatctcaaactgcgagggccttgggcactccacatcttcacggacatgggttgttattgctgttggtttgtgatgtttgagtccttctaataggggtccagggcatcccatcatggtaaatgggatggtgaggttctcttcactcatggatttcctgtcgttctattggctttggtgaagtaactattctttttgcgtacatttttggttttcttacagttgaattttgaaaattcttttttctgcatagtaggtttttgttctttttttttgtttttttctttttaagagacaaagtcttacttggttgctcacggcagcctcacactcctggggtcaagggatcctcctgcctcagcctcccgagtagcagggactacaggcatgcactaccacacccagctgatttttttttttaattttgtaattctttgtagcggtggggtctcactatgttgcccaggctggcctcaaagtcctggcctcaagcgatcctcctacctcaacctcccaaagttctggcattccagccgtgagccatgagccacagcacccggcctggataaacgttctttattgggtatctgtcttgcacacgttgtctcccagtctgtggcctgtcttttcatgaagtcagctttattcattttttttcttttatggattatgtccttgatattctatctgagaaatttttccctaacccagtgtcataactgttttttcctagaagtattaataattataggtttacatttatgcctctgatccattttgagttaggttttataaatggtaagaaatatagatctagattttgtcttattttgtgaatgaatgtctaatatttccagcaccatttgtcgaaattactatcttttctttgtgcttttattgaaaaccagtgatatatgtgtgagtaatttcttgcctgtcttctctgatcagtgtgtccagcccttctccagtaacacccgttttaattactgttgatttccagttagtcttgaaatcatacagtaaaggttatccaaatttttttcagacttgctttggctattctagttaccttgcttttccatatagattttagaatcaccttttcaatgtctaggagatatctagctgtgattttttttttttcttttttgagagcgggtcttgctctgtaacccaggctggagtgcagtgtagctgggatttagattggggttttattcactatattgattggtttggggagaattgacctctttactgtgttttcttccaatgcacccatgtgatatgattctgtattgacttaggtgtttggtttccttcattcgtgttttgtagttttccgtgcacagctattgcacgtagtttgttaaacttgtatctattttatgtttttagagcttaaatgagatattagctgtaggcgttttataggtgccctttttaaaatttagaatgttcctttaaattcctactttgctgagagggttttttcttttttaaaaaatcacaattgattattaaattttgccgaatgcttttcctaaatctattaagatgttcatatgtttttctattttattctgttgatgtgatgaattactttgattgttattcacatcttgagccagccttccatgtataagatacacctcgcttgatcaggctagactatgactgttatatattgttgaattttattttctaatattttgttgaggatttttttgaatttgtgttcatgatggatattggtctatagttttccttcagaggctttttctgattttggtatcagggtaatgctttagaattggtttaatttattcctcaaatgcttggtggaattcatccatgaaatatgcgtagttcttacctttgttcctctggatgctgtgtgtctgcgctcccaaagcttctgtcctctcttgtagctcacattcagccttcggccattcattgaggattttgggtgaatttcagaatttccattgtctcctcctcccgcgctctgtgacgggtgagcaggacccatcctgactccttggacaggcccatctttccttgtgtttccgaccacctggctggtatgcaacctaagctgtcttatgggctcaggaaaagtgattgttttgtactttgttcaacttttcttgttcttaggtggatgtgatgttctttccaatgctcggcatcccaggcacagcaagccctgtgtccatttttaacccacacattttacaggatggcaagtagggcagtttcctggtgacttagagagggggccgaggggcatcacagccatgaccagcagtggatggggacagagggtcctcctgcatgcctgggaagagaagacttgaggggcttggccaagtttatgtttgtctcatctctgcctgagacgggcttttggggaagggagccgagaagagtgtagcgattttcaccaggaccacatgggatcccgtgtgttccggccgagaagacccttgtttttctttctctgcgtggatccacaggatcttaggcttctgtgcctcactttagaacaagcacctgaagaaccaggaccttccttccacccagtggaagccttgatggtgcagccggaggcttggctcctctctgcaggccactggggttcccatcctgaagaagctagccctgcccactgccctttccggaaggccttcagttccccattgccttatgtatgcgtcatcagccgtgctgctgggcacggtagacaatcccagcgagacccgcgcactgtcagcaccccgcttccccccacccctcgtccagccgtgctccgtgtgcacccatcctcgccaggctccttggcaacattttgccttttcccatggctctcccagctgagagtgcccttctcaagaacttacccctcacaggccacccttcctcccaaacacagtccagatgaggccctccagccctcccaggccagaggcagtcatctgcccttcacgagtttgctgctctgcagagcatctgcctcttacagttacacgagcatgtcccctagaaagggcatgccctgaaggcagtcatttggcaggtatataattgggttcaatagctgttctgtaaaagagagaaacaaactgtggaaaatccaaaaatgattgtccccgttgacagacaaagagaaatttaacctccaacagcatatatgggacaagggtgatgattttgtttgcttgttccccaccccccgcctcaatgtaatgaacaatttagcttgaaacatagtggtatatattgagggaggatttctagatgaaaccttgccttgatctcaaatatctgttcattgaaaaagagattagagaaagctttgcttgccgtccgtcttggaaccacaggaaaggcccatctgtggaatgagaggatggtctggtccacctttctgcctatgccttaaagaattctgcaagagaaaatgaaaaatagcccaattctctttcttggtaatgccactgtaagcttcccaaaacattcatcacacttcctcggtctcagtgcaataattgcctgtgagcatgatggcagctaagggtttcctttctgtctctccaccccatggtccctcctgccatttgttctgctgtcatcaatgactgccctgccacagtgcccaccgcgcccccgcagaacgtgcagacggaagccgtgaactccaccaccattcagttcctgtggaaccctccgcctcagcagtttatcaatggcatcaaccagggatacaaggtacgtggcctgggttcagggcctgtgggcagctgtcattgtctggagccacagcgcgacgcagctggaggcaccccctcttgtgtatcaagagctggttgcattaagatacagggcgtcttgaccttggtgagaccaccatttatccaaagtcttggcatcagctctgcaggttcagaaattcaaattcctagttatcaagaggatggttcatacatcagtgagcaatttcttatgagaaaggccattcatttttaaatggtgggtgggagacgtgtctcagtgattagaatgaatatttgcacaaactacttcttcccagaaggaggtcctctcaggagaacacaggccccgagcaaagggaatggtgtgagtgatatttccatggagaaaggatagttttctctcctccctttctacttcagggagagttctgtttaaagaactgagaccagttgattccagctacccgcccatactgaattagacacatagacaaatttccatcatccgacttcttgtgtctttagctaccagagtgtgttaacttcactgatgtaccaggatacaccatcacaaagcacagctgatcctccctttcagatcagcttctcctgattggatttgggagcgcaccttgattttagctacaataggtccactaatcgtctttaatagacgatggacaggggaagctctatacagtgaagggattccatctagtttcctcaatacctggtaatttcacattcagagggtgagtttcctcagacacaaggttcagttttcttttcccacaatttgcattcaacttactaaaacactgatttgtctgccagaaaggcagaagtagctggaaattttccctgcctttcgtttaccctcagaagtatccaaagccagaagcttttgtgaaagaaaatcatattgatcaagcaagatgcttttgccttcttccctctcctgtcgagtctcgttggcaaggctgcagtgttcgtttgatgacttcgctgtcagtttgatctgtgtaaatacgctttgcgtcctgcagcatgtcaactttcagacccaattagtcctagaaatgtttggtgccaaaggaattaaaagtcacacacctacgtaatgctgccaaaacatgaacacgctttccttaggttgtggatacagtctgtatttctttaaaattgtaagcagtctcctaaaatcctttttgcgaaactagtgtgatataaattataaataattaagattattgctgttgaatcatggatgtcttttttgagacagagtaggtgctttctagaaaaatatttgtatttgtttcattgtgctgtttcagctgaattaacagatggtttcatctttattctttactgttaaaatatatattatatactatatggtatatattatatataccatatagtatatattatatatagtatatataatgtattatatatacatacatactatacgtatatattatatatactatatatgttatatatatgctatatatgttatatatgttatatatagtatactatatgtgtatatgttatgtatgttatatatagtatactatacatatatatgttatgtatgttatatatagtatactatatgtgtatataatatatatgtataatatatacatattatatataatatatgtataatatatacatatagtatatatgtatatattatacattatatatgtgtatatattatatatgtatacataacatatactatatatgttatatagtatataggttgtatataatatatatataatatatactttttatgtatatatgttatatatggatatatgtaatatatattatatatatgttttttaaccttcttaagtgaagagagggtgaagatttgagggagtgtccattattctaatatgagttaagtagttatttacatatacaagtataaaatacatgtaaatatacatgcttgtatacaaaaacctataaaatatatttttatctcaacttttttcaagcgtgattataaaatgcaggatttatggactttcttaattatgactttacattttaaaagacaaaataaaattctgctgcagacatgagtgtggagaaatgccattgaaaacaggctgtctttttcaccctgttccatctcagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacagtgagtattcctttctgcgtgtctcttaagtcacttgtcaaagaggtgtataccgctgcaacttccagaatcaggcaagggcagaggtggatcacgaggaggccccggatttttggagtgcttgcagtcagctcacctagggagatcaggcatcagtactgataatgcctcgcagaggatggcacgtggacagtggagggtggccttggctcaaggaaggagctctggggacagggggtggagaatcaggttccagctgtgtggccacagctttggtcttgctgaacttgctcttcatgtagagttcaatttctgattccctcacctgcttccatgatccccccccccccgacgtcccccagcccattctttcctgaccctcgctcccagggtccttttccccacgcccttctaagctccctgagtttgcattacctccatctggtcagttcgaagccactccttctctgctcacaggccagctgacgcatctggaaaacgttagctaatgaagttaccccgagaaaatagtcacagatgcacacaaagatttatatatatacaaggcggctcgttacagttatttgtagctggaaaaaatgtgaaaagcattcagatgttccagatggggagaattgggaaaaagtatagaatgacaacataagaaatattttgtagttgttgaaaaaacgaaactctgaagatcaaaaattgtgcgcaaaaatggtcatgatataacattgtgaaataatagtatacaaaactatgagatccaaattttataaaaatatactgtatgaaatatgaacagagaaaagaccttggaagaaatacgtcacacaaatttaagacttgttatccctatgtggtatcattatgagtagttttggcatatttcgttgtatttttttgcattttctagtttctaccacgagtctgtactccctctgtaatgaaagttaaaactagaataattagggccatgcagtggttcatgcctgtaatcccagcactttgggaggctgaggcagttggatcacgaggtcaggagttcacgaccagcctggccaagatggtgaaaccccgtcattacgaaaaatacaaaaattagctgggtgtggtggcaggcgcctgtaatcccagctactcgggaggctgaggcaggagaatcacttgaacccaggaggcagaggttgcagtgagccgtgatcatgccactgcactccagcctgggtgacatagtgagactctgtctcaaaaaaaaaaaaaaaaaaaaaattaggaaaattattttttaagtcaccctgggctgctgcttgtctctcccccagtgctggatgggctcagccttctgaacttgtctctactagagtttggccgtcgccagctccaccccgtgctgctcccgtttttggactcccagcctcaccgcactcccagcaggtgacatttgcagaggccaaggccaccaagacggattccttgccttcccacttcaccctttatttccgtgtccttacgcttgcctctctcccctttcctctcaaacgatgcagtatggcctttctaagggtcctccgtcatcctgttcccttcttcccctctctgtcttcatggcgctattacttcttccaatctttttactattggatcctttccctcctcccacaaatatgttcaggtctccctcactcaaaatcggcagctccctgactgtgctgcccctggagctgccgggatggctccccactcccttttagtctaaccattgctttgaccttgaacgccttatgttctccttgacccttggcagcctagctttctccttgccactctcctggaacaatctcgccattgactcaaggtctatgtcaaatgagtgacaggggaggaatagaacatggatttcttgaccctctgagaccaacaatcaatccctcctcacaaaaaagatgaaatgaaaagtagccctgctgctgctgtgaattgatcccagaagttcttcccatactctgcctttgctctgctttctgcttttgtttaactgattttggctttttttgttttttgggttttttgttgttgttggtggtggtggtggttttttttgttgttgttgttgttttgagacagaatcttgctctgttgcccaggctggagtgcagtggtgcaatcttggctcactgcaacctctgcctccagggttcaagcaattctcctgccttggcctctcaagtagctggtattacaggcaccggccaccacgtctggccaatttttttgtatttttaatagagatggggtttcaccatgttggccaggctgctctcaaactcctgacctcaggtgatccgcacacctcagcctcccaaagtgctgggattacaggcataagccaccacactcaccaaggttaactgaaatttttattgagagcattacagattcatatgcaattatatgaaataatattgagaccgtgtacatttagcccagtttctgccaagctgacatttgcgaaactatagtattgcatcacgtccaggatattgacactgatgatacaattcacagatccgatttgggtttctccagttttgtttttttctcttttgtgcatatgtgtgtgtttagtcctgtacagtttgacacatgtgtaggtttgtgtatctaccacgataatcaagatcttgaatgtttctaaggccacaaaaatcatctgggttcctttatagccacacccaccttcctccagctcttcctttctaacctgtatgcctttcatttccttttcttgcatgatttgcagtgtctaggatttctagtactatgctgaataagagtgatgagaccagacatccttgcctgcttctcacctgagaggcaaaacattcagtcgttcactgttaaggatttttttttttaatcaagttgaagttattcctcactattgctaattggttctgagtttttgacatgaataaatcttactttttttcacgtgctcttactgcatcatttgacatgatcatctggtttttcttcttagcttgttggtctgttagattacattgactgatttgcaaatgtcaaaccagctttgtgtacttaaattcaacttggtcacagtgtataattcttttcatatgctgttggattgactttgctagcacttggcgaaggacttttgcatgtaagttcatgagagatattaatctgtagttgtctttttttgtgtgttatctttgtctggtgttggtatcagagtaatatggtcccatgaaatatgtttagaagtattcccacttctatgttctggaagagattgcgtaaaattggtgtcattttctctttaaatgtttggtagaattttccagtgaaactctcagggactgaagaattctttctaggaatatttttaatataaatgcaatttataaatggttttaggactatccaggttgtctgtttcatcttggctgagttttgggagttgttggttttcaaggagttgatcctctaagagttcagatttgtgagtatgaaaatgttagcagcaccaccttcttattggttgcaggatctgtagtgatgtcctgttttttattcctgatattgatgattggtttcttctggctttttaatgttgtcattcttcctggaggttcttcaattttattgcttgatttttttggtttgtttttgttgttgttgttgttgttgtttttgttttttgtttttttagaaccagcctcttgttccaggtctcctcttcttcatggtctccttcattttcaactttattgatttctgctctttataatttccttcctctgcttgctttgagtgtattttgctctcccttttctgctttcttgaggtagccatgttggttattggttgaagacctttccttgtttccagtgtgagcgtttagtgctgtacatttctgcttccatgatgctttagctgcatcccagatgttttgacactctatgctttcattttcatccagttctctgtatttttatttcctttgagatactctctgtgacccatgaattaattggaagtgtgctgttcattttccatgtgtttggagattctattgtctttctgctattgataatctgatttgattccattatgatcagagaacacacttcatataattttagttattttatatttgttgaagtttgtttaatggcctaggatatggtcaatcttggtgaatgttcaatgaatgattttttaaaaatgtctatttctccttttcaattgtaaattttatgtctcagagaaaactggaaataatctcaattttttttttttttttagaattttctaactgaatcattttttggtaggcagggagcctgtttatcctatttaggataataacacatctttgtaaatgtcaaatatcacattaaaagactgaaggtagggttgaagtcacctctggggggtgtagcttttaaaaggaaagtttggagcctgaatgagaggggcttcaggggccagctgaccacagtcacctggtactggcctccttcataaagaagaacaagaacagcaagtaggtaaccacacttcaaatagatccaagagagaagctggaattcaatagagaagtgacaggaagcacctatggcaaggaggaaagtgaagtgcagcagctcctccgggactgagatcggctgggaacccagacaggttccccactgtgggaaaagggaaagggagagacccccgtggtccacattcccaccacagactcctgcaatccgagccacaggaaagcccctcaaaactcacaggcccaagactcacgtagggagactctcacagggagaccgtgtgatgtcctgctccagagagggagcccacgctgcaccccacacgcccgagcccagagcagctactatgcagtgctgctcaaagagcccagccccaccagaacattccgccgtgggtcccaccagaccattccgccccgggtcccgacagaccattctgctccgggtcccgacagaccattccgccccggctcccgacagcctctgcatctccatattctgcagccccactgacatcccctgcccacaaccaccaccactgctggctgctgccaccagaggcaaagcacaaaccattggcagtgacccccagtggtggggctgctgggcattttcactcatcttgaggacagacttcgcttccaggcaccctgaggtcagactctcccacccacagttgccacctgggtctgaagcacacctccccagcagcagggccgcagtgcagccattgccagccctaccaagtgttctgccaggaacctgggggtcaccccaccccagctgaccacagctagcaactgcacacaccaccaggggtcctgaggacaggcctgcttggcttgctcagcctcccccagtatgagcaacactatccagggccctgggctcaccctgccctgtccaccactatgagcacctgagtacttctcctggggacctgaagtcgggcccacccaacctgctgcaccatcacagctggcacccattcctacacaccacccctgggcctggggactggcctgctcagcctgtcacagccaccagcaataccagtgcagactgctaaggagccaggggattgtcccaccactgctactgtcactgcctatagcatgcctgctgtccagggccttgagaacccacccacctgcttggccccctgcagccattgccagcacctgagcaacccacctagaatgccaagaatgagcctgtctggatcactctgggatgtaaggacaggcacactcagcccactgctgccaccactggggcccaaggattggcccacctggtgtccctgtccccagcaaaactttaccacagcctctactaacaaccacaccctaagccgctgaggaaatcacagacaccactgatgctgtttacagccaaataaattatatggagactacactactgcttcatccagaatcaaagccaaagtaccctatccaatcaacaccatagatacatcttcaggaaaaagccctcctttatgaaagcaaatccaaaaaattagaagaagcaactgttacaccagatgtgcagatatcaacataaggacacaagaaatatgaaaatgcaaggaagtataacacttccaaaggaacatggtaattctctagcaacagattccaatgaaaaagaaattatgaaatcccagaaaaaaaataaaaaataatgatattaaggaaagtcagataaaagagacacagataaataatacaaaataatccaaaaaacatttcaatacatgaatgagaaatttaccaaagagataaatattataaaaaagaaccaaacagatatccaggaactaattaattcattgactgaaatttaaaaatacaatagtaagcttcggcagtagactagatgagacagcagaaggaatttcagaatttaaagttgaataaagactatgtgatatatgagtcaccataaaggaatgagtatttgaatttttgatgtcccagaaggtgaaaagaaaaccaaagggatacaaacctgatttaacaaaataatggctgaaacccaagtctagcaagagatttagacatccagatatgggaggctcagagatccacaaataaatagatactattcagaaaggtcttctccatggcacattgtagtcaaattatcaaaagttgaagacagaattccaaaaacaccaaaagaaaagcatctactcacttataagagaacccccatcagactaacagtggatttatcagcagaaaccttacatgccaagagaaaaatgggatgatatattcaaagtactggggaaaaaaataacttgttagccaagagtactatatgcataaaagttacccttcacaaatgaaagagaaataaagtatttcctagataagtaaaagctgagggaattcatctccactggactggccctacaagaaatgcttaatgaattcccacacctgaagtgaaagaacaatatctaccatcatgaaaatgtacaaacgtataaaacccattggtagagcaaacacacaaataaggaagagaaaggacccaaatgttaccactacagaaaaccaccaaacctcaaaaataaacaatgagagagaaagaagggaacaaaggatatataaaccaaccagaaatcaattaataattactagaataagccctgacatatcaatagtaaccttgaatttaaatagattaaagtatccaaaaggatagactggctgaatggataaaaacaaaaacaaaaacaaaaacaaaccatgacccaactataggctgtgtacaagaaactcagctcacttgtaaagacacatgtagactgaaagtaaagagatggaaaaagagattttgtgcaaacagaaagcaaaagtgaacaggagtaggtacgcttagataaaatactttaagtaaaaaacagtaaaaagagacaaagaaggttattgtgtaatgataaagttatgaattcaacaagaggatataacaattctaaacatatatagaccaaacactggagcactcagatatataaagcaaatattattagatctacagggagagacagcaatacaataatacttggggactttaacatccccctctcagcattagacaggtcatcttgacagaaaaataacaaagaaacattggatttaaactgcgctttagactaaatggacctaacagacatttacagaacatttcatctaatagctacagaatgcacattcttttcatcagtacatgtaacattctccaagacagaccctatgttaggacacaaagcaaatctcaacaacttttaaaagactaaaattcgatcgatatcttcttagaccacaatggaataaaactggaaatcagtaatgaggaactttggaatctgtacaaatacatggaaattaaatagcatgctcctgaatgacctttgggtcaaggaagaaattaaggaggaaatttaaaaatttcttttttttttttttttgagacggagtcttgctctgtcgcccaggctggagtgcagtggcgcagtctcggctcactgcaagctccgcctcccaggttcacgccattgtcctgcttcagcctcctcagtagctgggattacaggcgcccaccaccacacctagctaacttttttgtattttttagtagagacggggtttcaccatgttagccaggatggtctcgatctcctgacctcgtgatccgcccgcctcggccttccaaagtgctgggattacaggcgtgagccaccacgcccggccagaaatttcttgaaacaaatgaaaattgaaatacgacatacagaaacctacaggatacagcaaaagcgatgctaagagcctacaataaatgcctacatcagaaaaaagtagaaagatttcaaacaatctagtgatacacctcaaggacaaaccaaacccaaaattagtagaaggaaagatataataaagatcagagcagacctaatgaaacaaagacttaaaaacaatacatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattgtgtaggttgcctgttcactctgatggtagtttcttttgctgtgcagaagctctttagtttaattagatcccatttgtcaattttggcttttgttgccattgcttttggtgttttagacatgaagtccttgcccatgcctatgtccggaatggtaatgcctaggttttcttctagggtttttatggttttaggtctaacgtttaggtctttaatccatcttgaattgatttttgtataaggtgtaaggaggggatccagtttcagctttctacatatggctagccagttttcccagcaccatttattaaatagggaatcctttacccattgcttgtttttctcaggtttgtcaaagatcagatagttgtagatatgtggtgttatttcagagggctctgttctgttccgttgatctatatctctgttttggtaccagtaccatgctgttttggatactggagccttgtagtatagtttgaagtcaggtagcgtgatgcttccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctaggactagaaataccatttgacccagccatcccattactgggtatatacccaaatgactataaatcatgctgctataaagacatatgcacacgtatgtttattgctgcactattcacaatagcaaagactttgaaccaatccaaatgtccaacaatgatagactggattaagaaaatgtggcacatatacaccatggaatactatgcagccataaaaaatgatgaattcatgtcctttgtagggacatggatgaaattggaaatcatcattctcagtaaactatcgcaagaacaaaaaaccaaacacggcatattctcactcataggtgggaattgaacagtgagaacacatggacacaggaaggggaacatcacactctggggactgttgtggggtggggggaggggggagggatagcactaggagatatacctaatgctaaatgacgagttaatgggtgcagcacaccagcatggcacatgtatacatatgtaactaacctgcacattgtgcacatgtaccctaaaacttaaagtataataataataataataaaaacaatacaaatggttaaacaaaactcagttttagggaagatacacaaaatcaataaactgctagctagacttaagaagaataaaagacagattacttaaggaaacaaaatcagaaatgcaaaaggagacattataactgataccacagaaatacaaaatatcatttgagactcttactaacaactatacactaacaaattggaaaacctaggagaaatggataaattcctgaacacatacaacctaccaagattgaatcagaaagaaacataaaatctgaacagactaataatgggtaatgagattgagtcagtaataactctcccaacaaagaaaaacccagggccaagtggtttcactgacaaattctaccatactttcaaggaagaactaaaaccaattctcctcaaactattccaaaaaattaaagaagaggaaattctttctaactcattttatgaggtcagtgttacccagataccaaaaccagacaaggacataacaacaaaaaactacagtccattatccctgatgaacatagacacaaaaatcctcaacaaaaatattagcaaactgaatccaacagcacgtcagaaatataatacaccatgctcatgtgagatttatcccagggatgcaaggatggttcaacatatacatatccataaatgtgatacatcactccaacataataaaagacaaaaaccatgtgatcatctcaacagatgcataaaaagcatttaataaaatttaacatccctttataataaaaactctcaacaaactaggcatagtagaaacatacctcagtatgataaagtctgtatatgaaaaacccacagctaacatcacactgaatggggaaaagctgaaatcctttcctctgataactggaacaagacaaagatgcccactttcatcacacctatttgtagtactggaagtcctagccacagcagtcaggcaaaagaaaggaataaaaggcatctaaattggaaaagaggaagtcagattgttctctttgcagatgacatgatcttgtgtctaaacaaacctagactccaccaaaaaactcctatatctgataaataaatttggtgaggttgcaggatacaatagcaacacacaaaaatcagtagcatttctataaaccaataatgaactagctgagaaataaatcaagaagttgattccatttacaatagctataaaagaaaaacatatctaggaattaatttaaccaaggaggtgaaagatctctacaaagaaaaatacaaaacattgatgaaaggaactaagaaactgaagaagacacaagtaaatagaaagacatcccatgctcatggatcagaagaattagcattattaaaatgaccatactccccaaatgaatctaatgactcaatgcaatctctatcaaaataccagtgtcattttcacagaaatagcaaaaaaaaaaaacaaaaaaccccgtaaattcttgtggaacccaaaaagagcccaaatagccaaagcaatccatagcaaaaataacgaaactggaggaatcacactacctatctttgaaatatatgacaagtctataataaccaaaaccatggcatggtattggcgttaacaacagacacatagaccaatggaacagaatagagcacccagaaacatatccatatatttacaaccaactgattttcgataaaggtggcaggataccttcaataattttggtgctaggaaaattggatatccatatgcagaagatcgaaattaaaaaataactcaagatggattaaagacttaaatgtaacacttgaaattataaaactactaaaataaaacacaggggaaacacttcaggacattagtgtaggcaaagattttatggctaagatctcaaaagcacaggcaacaaaaccaaaaatagacaaatgggactatatcaaacttaaaaacttctgtacagcaaaggaaatggtaaacagagtgaagagacagcctgttgaatgggagaaaatatttgcaaactattcatctggtaagggattaatatctaaaatatacaaagaactcagctcaacagtttaaaaaatctcatttaaaaagtgggcaagggacatgaataaacccttgtcaaaagcagacatacagatggtcaacgtgtctatgaaaaaatgcccagtatcactaatcatcaaggaaatgctaatcaaaacctcaatgaggtaccattttatcccagtcagaatcactagaattaaaaagacataaaaaatgctgacaatcatgtggagaacagggaactctaatacactgttggtgatgatgtaaattagtacagccacaatggaaaacagtataagttttcaaaaaactaaaaatagaactaccctatgagccagcaatcccactattgggtatttatccataggaaaggagtcagtgcatcaaaggatacccataccccatgcttactgcagcaccattcacagtagccaagatacggaatcaacccaagcgtccatcagtagaccaacggataagaaaatgtggtgtatatacatagtggaatactattcagccacaagaaagaatgaaatcctgtcatttgcagcaacatgcagggaactggagggcattacatcaatgccctcaggaaaacaaatatcacaagttctcactcataagtagtagcttaaaaggccaatctcatggagataagagagtagaatgaaagatactagaggctgggaggggtgtgtcggtggagcagggtggtggggagaaagagaggttagttgatgggcataaacattcagttaaacagaaggagtaagttccaatgctccgtggcacagtagagtgactacagctaacaatgatgtatatttcaaaataccaaggaaagaggatttcgaatgttcacaacacatagaaatgataaatactccaggccataggcactctgaacaccctaacttggccgttacacagtcagtgcctgtaacaaaacgtcacctgtaccatagaaatgtgtacaagtattatgtatcaataaaaaagaaagtaaagaaagcttcagactctcgggtgctggagaaacggcctccttttctctttagctgatggtgctgtagttagttccacacccagcaggacttctttcccaaagctccgaggaaatgagaagttgttgggagagggtagcagtaaagaggaaacagaatataaattttaagctgagacatcgccagctgattgcagcagagctagaggacagcatctttgggcaggaatccaggaagcagaaacataatataaaaggagcaaaaaggtttctttccttctccatcgattgaaaaaagaacaagtcagtgcaaaaatctgtcagaatgtctttctggaggctcacaattgtgggaggatgagatggtcttgacagccattctattttaccatcttccacactagaaaagtgaaatttatcagagcatttgagcttatctgtgaaaagtcttttcaaagtttcacccagatgagtggttgttgtttttttttttttttttttttttttttttttttttgaggctgttaccattttaaaaaaattacgacttgtgttagaaggctttgtccaagtaccaactcagtgctcggtatggaattcaccctaaaaatctaatgtttgtgcaagtgaggctggcagtaaccagaacagggactttgcaggggtgagacttctctgtaggaatcctggatactctttcaggacaactgacacccttgacttcatgctctcctattttaagctgaaagacttgcattttttattactaaaaagatttgaatgtggcgccatccagcaggttcactaggggagtcgtgtggtgtggagctttcagtaggaaccagtgttccctgcctggcgtggagggtgtactcagctgatacatacagaaactgacggatgtctcgtctcttctccatcattcttttcctcccttttccccggttctgcctttgaactaccctttcctcctgcccttttctcctccctggctttgtcgctatgtttctcctgaacgggtatctggaggggtaggcatgggggcattgtcagagaggaggtagggctctcaatggcaggcggggaagcagggccaacccgggcagctgtgtttgtgtttgctgctgagatcaatggatggaggggcactttcaggcaccgcacaggtgcctgtggtgcctgacttagggaatgggagtgcactgtctctcttcccctcatccttccctccatttgctcgtaagacgccagcctccccaaaagcgtttccatttccacctgctcctcatgccttgcacagcagctatggctatagagagaccatggaaggcacatggcagggcttgggagtaacggcatccgggagaacatcaccatcaggacatccacctatctcctccagatagccaggcatcctctcctccctccccatcaccacacagtgtgggctggccctgatgggaccgatgggacctgctatgggaacactaaaaggctctaaacctgggtgagctggtgcaagagatgtgggtcagaactgccagatgtccctgctgtccggccagcagcgacttgctgtgggccctgctgtccctgagtcgcaggcaggtggtccatctgcatgtggggcggagctctgcgcctgtggccgcccttcctcaagcagtttgctttgctgagctgcacctgcatcttggatttttaactcatgttttagactctcaggtcttttctctggggtggcatcctctgatcctaggaatgagtttatgttctgatgagaggttcatcatcatgacagcggctgatgatcatggaacattttcatggtgcccgggacatcctcgtgttttcatgttttattacaatttattcttataattgtctcgctgagttatttttattttccctgcttcacacattaacagactaaggtgtcgagagtgtaatttcctaggcagcaagtagctcagccaggtctgacacccagcttggacgccagcgttcaagcgtaactctgcggctctgcctgcccgtgttagcaagggggccgcagggcacagaagctcctgggaaaggaatttgtttttgctgggattttctcaggccactgcctcgcccctctggaatccttcaggataccgattgggtttggagcctggagttctggaccaggttggcaggtgagcctgcccctgggcccagggtccttttctggtttgcacaaggttacagatggcccccacacaagccagacacggggttgcatacaccatggaggaacactcagaggaggcagttgctcttgagaatccagccagcctgattgttctaatcagattagatcaaggagaaagacagagaatggtttgtgtataaatctcctgccaccagtagctccagtgccctgtgtggctgggatgaagctggagaaaataatgtgtgtgatgatagccaggatgccttgaacaccctccttctttctgcattccactgatgtctcctgcagggttttgcagccccagctcaccactttccttccatagttagaaccttccccacacatctgatcaaaagaaaatttgggctattgtgttaacagatgactttgcttttaattggtagaaccaggagctgtgggacatctgagtttcacagagatcttggacacatctctcaaggtcagctggcaggagcccctggagaaaaatggcatcattactggtaagtaggcctgtccttcaaaaaaggaaaagataagtttgtcctcacaaaaagaagtggctgtcacttcaaaccaaactgctgacagcatggacccgtgcccatggccttctcaagaggaactgaaaagtcttcctggccgtgtggcagagtcccagcactgggactgccccagtgagagccagcctggtctggggccctttactgtgtgggcagcagccatagtttgagatctgttctcctcgcatgatcttagtaggtgtccagagtctctgaccaatgagagtcagtcatgttatgacacatttgttcacatgcgtgtgtcttgcttaattctcatagcagcatggtaaggtcaatatcgatattatgaccattttacagatgaggaaactgaggccccgagagggtgggtgacctttccttcattcagcagatggcactgagcgctcctgtgggcagccagccttctcagacacagccaggtggtgtgactatgaggcttacgtgcctgtgtctcagccctcgtcccacagctgtgagccgcaagggtgagatctgggtcttctgactccagatcccatgttctgtcccctccccaccctgccctccagtgagagccctgaggagactgtgaggcaggtacttcggaggaggttctgagctgtaccagggatgggggctgagccttagaggcccctgggcagtgagatctcctctcctggtttgagggggtctctgtgggagacagctcaccttttttagggtttttaatgattttatttatttatttatttatttatgagacagggtcttgctctctcgcccaggctggagtgcggtggcgtgatctcggctcactgcaacctccacctcccgggttcaagcagttttcctgcctcagcctcctgaagagctgggattacaggtgtgtgccaccatacctggctaatttttgtatttttagtagaaatggggttttgccatgttggccaggctggtctcgaactcctgacctcaagtgatccacctgcctcagcctcccaaagtgctgggattacaggcgtgagccactgcgcctggccaaatttttataatgtctctgaaaaaccttttaggttaaagcttaatttaaatcttagttcaaaaaaaaaatcttggtttgacaaaagcaacataggctctagcctcagatgaggctgggcagggccccctgttctactgttttagtcactctaagagcctcagcagacctctgggatcctcagttacaactgaggggctgtcaggaggacgagttgagagaagttgtatcagtggctgcccactgcctggcccagaacaactcagcctccaacagacatctgttttttttctaaacattaccaaggatttctagcaagccacttaatcttcttctctgtcagccatatataggacacttctgtgtcagccctctctgggggctttgcctgtggcatctcatgtcccggcaggggctcctgcgtgggtattctgcagccgcaccccaaggttgagtgagttgcccgtcctgacgcgagcggtcagtttggagctgagctgcgtctccgctccgtggtggcagcgttctcagctgcctgcgggagccatggaattcaagtgcctgattgttctgtgaagcaagcttatgctctctgggtgtgtcctagaagcctgtgctgggactgtgctgcccagagaccaagagcctcaggtgatctctccctcctgccaggctgcagggttgggggccgtttcttctccgcactggcgtcctggatgacagcggcaatgatgaccctggccacttccactgtgtttgtcaccctagccttgtgggatctcgttttgctttctcagcaaccacacaaggggtgtcttataaccgaggcctggcgatgacaaggctgaggtttagggtggtgacgtcccaccatcacagccaatgggcatgtgcgcattctctcctctgcagcgttgatgtggtgggggtgaggtttgaaccatgctctgaaccccacagcatgggatgctcactttccccatccacagtcctcttagcatctccataatttctcaaagcaccctgaggccacagaaatgcctgacggttctgtttattaagtagttaggtccaaacaacggaagtgttaatatgcgctaacaattataattgccatgtaaaaaatactacacagtagttgaaagaaataatacttgcatttcttttttcagtgaccacagttagttcctaatgggatgtctgcacccgcctgggactgcccaccttctcagaccttgggaccagatggtccctcgtcaccctcatttcccggttcactttggtttccaggcagtacttgtttccttatcacaacatccaccaaaaactctgctttgcaaagacaggatatatccaaggactcgtggcatgctctgacccggaaatggagccacctcgggctggaggctcacgtgtgtcccactggcattgagtgtcctgtgcatccctgcagtgctcctgggaggtcactgcagcatcccaggtgccctggggcacagtgggagactgtgttcctacagtgacctctttctacacagaactccagctacatagcaaacccagtgccaaccccaccactactcatcagtagaatctcctgtaatcatctgtgccaaccagatcccctgatagagcggtgtgcccacagcccatacacaaggtcaccttggagccagtgccacctctcaaatttttttttttttttttgagatggagtctcactctgcagcccaggatggagtacagtggcacaatctcagctcactgcaacctctgcctcctgggttcaagcaattatcctgcctcagcctcccgagtagttggaactacaggcgtgagccaccacgcctggctaattgtttgtatttttagtgaaggcgggggtttcaccatgttagccaggatggtctcgatctcctgacctcgtgatccacccactttggcctcccaaagtgtgctgtgcctcttataagcatatagctggactttgtggggtttttaattttttgtttatttattttttgaaatggagtgtctctctgtcacccaggttggagtgcagtggtgtgatcttggctcactggaacatccgcctcccggttcaaatgattctcctgccttagcctcccaagtagctgggattacaggtgtgcgccaccacacccagctaatttttgtatttttagtagagacagggttttaccatattggtaaggctggtcttgaactcctgacctcaggtgatccacccacttcggcctcccaaagtgctgggattactggcatgagccaccacgcctggcctcaccttaacttttaaaaaaagtaaattaatgaatctggctctgccttccagaagcttatcttttgaagtgcccactttaaatagtgtgaaaactccaggaatggggggaagtcactactagaattggacacaatctgttgcacattctgaagtcatctgagaatcgcaagtgctgagtgtgtacaattaaaagggcctcctgttgcctggagtcgaaggaattaagcaaaggcagggggaactgagcaggggagggcactatagactgcaggaacctagtttaatcttgctttaaaccattcaaagaaaggaaaaacaaactagtgggaggagggatttttaaaagctgagcaggaggctaccattcggaagaagaagactttccagttcagacccttcagggaccagttcagtggctggaattagagctctgcttaccactgatcccagaaacggggctgcccgggtaggaaagaaagaattctggcctaccgtctgcccagtcgcctttcaggtctgcagtcggccatgttttggaaatctggcagagactccttggtagatgtgtgtacacagaaggaattccctttttacagatacacacgttagcccctgccctgccctttgtgaacacagcacacacttctttcctgtttaaagctgaaagaaaaaaatccatgggcataataattcacgttgagccaacatttcacggctaagcagtggttgccaatacttccaatttatgatcgtctgtttcaccagctaatggggcttcatgaactcattttcatgttttatttaaacaaatacctgtagttaaaagcagcagtctgttgtttatggtggagcttgacttcgaagctcgagctttcctgggctgggtgtagccagaggcctgggtttggaggtgcctgtgctgtcaggggcagcaaagttgcagtgagagcaccaggcagactctctgcaggttcctctcggcagccacgttgtccccttctgtgtgtggcctgtgtgttttcccttcctgctcactgtaatgtgcaccttgtgtcacagaagctgcagtggacgcctgcagctctttggaggagaaggtcctagaggagatgagatcggatgttatcaccttaccagcccagcatcaccctgtgcccccagtgatgcccgcatcaggggagctccccccagcacccaccatgtagacatagttttccagtggaacatgctggcagcaccatgaaattctattctgtgctgaaggcagagtgtctcattgagaagagcaaaagaaaaactgtgttcgtgggcaaacctggctgccggtttctggaagtgttggtgcggcaccaccatgctctcgcaggcttcctgcaaaggctgcacctgctattaaaggcagctgcaggagcccaggatgactgacggcttgggcctgggctcagcaccactttacgggccagaggcgctgttggaaacgtaggtttattagccctggtctgtggtgagcacccccagcttccattttaattcgaggcctggaatgagagggaagcacggagtagggggcggctgcgcctgcccgagtaaattgcccattgcccgctcattgtaaatttcagcgtcctccactctccttcagtaaactctgatttatgagggccaggatgcagacagacagtttgtgattggatgcactgctctcttctagagaatttactttagatcaacagaaaattatttctgaagctcctctggccattagtctcagttaggcagccattgggagcaggtaggatgccaagcgggaggtacccccgctcctggctccgggcgcctctctcctctctcctctgggagctggaagcagaggatgcatcccctggccagcactgcctgagccctccacgcacctcccccaaaagctgttgttcataaattaggggacgtctttcccacctcacgcccaccactctgtctgtgctcacaggcatcacacgtcttgggcctgcaccatttctgctggcgtttctctgcagatcagcctctctagctatccgtttggtttttgtttgtatccacaaccatttgagcacactatattatcaatgttgatcctaataaattctatcaacactgctcttcctgaagatgctggaattgccgtgtttcagctctaggtcgacatgacaaacatgacgctgtgtttcagtaaattctgatgaaaaacagcttttaaacaaataaaattttctggcagacaagttgtaatattaaacaaagtctgctcttcccataggttcagagtagaccccgaggatcaaattatttagcgattgaccaggtgtgacccaccaaggtcagggatgtctcagttcccttgcacacatcaggaggaggtgctggaggaggaggcgctttgagagcagggtctcgtgcaccatgagaaacaaactcacccgtccaaacccaaagaatggactcagagacccggagaacagcgaaagtgagacttttaatgccggtcttgcaagatcgagtgtgtggtgggcaggcacactcagcacggccacaacaagcgatttatcccctagtgctcaggcccctctcccagttcctcataggctgagcactatggggtggggcgggggaggtcacagtcttcccggacatcgcctattggttgttgggcagggggccgtaggtgtttttttagggttgtcctgttgcattttgttgcagcccacaatgcactgcaatcctagtcagctcagggggtcttcaggtatttgacttacgacctaagtagctgggcaggctgataagaacagacgaaacgagctattctgcaggatagtaaactttcatcttagactaaacttctttggttggggtggggacaactgagggattgggggaggctgagaagcaggcatttgcgattgaagcaggggcttagtgtatcctgtttcttctgtagtttgctgacctaagctgattcaaggtactttgtcttggaaacggaccatgtatccattatttccttcatccactgagggctgtcttgggttccagcaagtccacgaagctttctgtggcttggtttcttcctttgtgaaataggataacaatggctccaatttcaaaggtgtgttgtgagggttacatgaatgaatggggcaggctagatgtcttagacgtcagggtgggcagatgagggaaatgctaagatgtaaagcgagggcagggcccaggctgggcgtggtggctgacggctgtaatcctagcattttgggaggccacggtgggaggatcgcttgataccaggagtttgagaccagcctgggcaacacagtgagaccctcatctctacaaaaaattttaaaaacttgccaggcatggtggcacatgcctatagtaccagctacttgagagactgaggtgggagaatcgcttgggttgagtggttcaaggttgcagtgagccgtgatcaccccactgcactccagcctgggcaacagagcaagactttctctctctctctctctctctctctctctgtatatatatatatatatatatatatatatatttttttttttttttaataaagttaggaaggaaatgggagaaggcaaaaatgagtggttggcctgggtagtcggccttctcccctctccctgggaggaggaaaaggagaccaggacctgagaagcagccaggcgcctttgatgaagacaccacagaggatggtttagtgaccctcctgggcccaggcagagaccccaaaggcaggcaggcagcaccacttggtgacaactcacaggatggcaggtgctccaagtgctctggaggcacccagcagccaggcctcccctctggtggcccttgttccttggagctccccactgcgtccgcccacacgggagtcccctcagcccgcacacagaagctgccaggctgtacggggcctgtggcacggccagggggagcagtttacgacattaaatttttttcaaaatataaagtctcaagatgctgtcctctaaattcttgtttacctgcaagtgcaactcctagctttatttattgctttcatcagaatgaggaggaagtttcaggtgcgtcctagcgcttctatatccctgaggttattgactagaaatagggaagagcaagcgttttcagctgttttcttttgcctgtggacctatgagctctttccaccactgtctccctctttaaaagacacttttaagtgctctctgatcacattaactcccctccacgcgggttgattgattcaggagctagttgggtcttatttctccttttttttttttttttaagacaaagtcttgctctgtcacccaggctggagtgcaatggcgcaatcttggctcactgcaacctccgcctcccaggttcgagtgattctcgtgcctcagccttccgagtagctaggattacaggcgcccaccaccatgcatggctaatttttatattttagtagagacggggtttcacatgttggccaggctggtctccaactcctgagctcaggtggtccacccgccttggcctccccaagtgctgggattacaggtgtgagccaccgtgccccgcaggtcttttttctctaagccccaagtcacagtggaatcccaggttgaataaattttcgtcatgaggccccactggcctgaagagagtatagggggaaatcaaatttattagaaaacaggatatatgaaaaggggagagagagctagaagcaaaactcacacactcaggtgaaaataaacttttccagtgcattgcaaaatgtaagagtaatctgtcagtcatttcttgaaggaaaaagtagaagtgtttccatgaattagttgcaaccgaagagcaagccattgatttaaggtacaaaaaatatcggcttccaaaaatgaaatgattggccgggtacagtggctgtaatcccaacactaagggaggccgaggcgggaggatctcttgagcctaggaattccagaccagcctgggcaacagggggaaaccccatctctccaaaaaaatacaaaaaattagccaggcatggtggttcacgcctgtggtcccagctactcaggacgctgaggtgggaggatggattgagcccaggaggttgaggctgcagtgagctatgattgcaccattgcacttcagcctgggcaacagactcaaaaataaatagatagatacatacatacatatatacatacataacattttttagtggaattattggtgaaatgcattcataatttgacaagagaaggtcgaattgagcacagcaggctggcagctgtcgtcatgtttcagttcacgcacctggtgctgaggttaccagagcatcccagaggccctgtccttatgaagctcgccctggtagggagggatggtcccctgtggtgggaccgtcactcccataagcaggtttacgagatcgcattgggcacacagaggaaggagccttgacctgtgtctcatgtcagtagcacagtggctctaagctgccttcagcacatccagccaagctctccatagctccaagcctgcaacgatggtgctgtggaattcaggtgagcccttggccttcaggagaccaacactggtctggtcctgttgctttctaggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccaggtcagtagaatcgtgtgcggtcctcctgctgtcacctttctcttggagattcccgaggctagaagttgattggcactttggtgtggaagccactgagtgccttgaaaaggagtagtggcctcctgccaagatgctggagggtaaatgggtgttgaccccacttcagccccattctccagagcattccaccacggcctcacgtcccttctgtcttcccctcctgctttggcctcagccagttcccagaacatgcgttgaaagtgtttaaagccagttcccaatgcatatctaaaatgccatgaatactttcaaaacagtagcgatgattgtattagtccattttcatgctgctgataaagacatacccgagactgggccatttacaaaagaaacaggtttaatggacttacagttccgtatggttggggaggcctcacaatcatggcggaaggcaaggaggagcaagtcatgtattacatggatggcagcaggcaaagagagagcccgtgcaaggaaactcccgtttttaaaacccatagatcttgtgagacttattcactatcatgagaacagcacaggaaagacctgcccccatgattcagttacctcccaccaggttcctctcatgacacatgggaaatgtgggagttacaattcaagatgagatttgagtggggacacagccaaaccatatcaatgatgatggtgtgtggtttaattgggtaaaaattggtatatatagcgaccaaggttaacactagaagcacatctgggtgcaagttaccagagttttcctgagatgtcttggacattgtttatccagggcagggaaatgggttagctgacctccggaaggctgtgcttccagaaacactctgacgcacactacgtctggagccacagagtggagtgttagaggggaaactgaggcctggctgctttggccaaacccctgataaccaaggtgcagggaggcactggagttgctgttccgtcattgccaaggctgaacgcttgtagctggagaggggtcttaaagccttacccactcatcctgggtagtggctggaggcaaatcaaatggcgaggactgctttggggacaccatgttctgtttaccgtgcttgaagtttatcgccattaatgattgaagaaccatttaaaaatccagagagctgagaaataggaaagagtccacttgtccttcaatttaaacattttctatttcaaattcattaaaaactagatgtggaaaggacccttgagatcctacagaccctgcccatgccgatactgaattgatcaccaaaatagtttcattgtccctgtgcaagacctggtttcaaacaccccaagcaacagcaaatgaggaaagcattcctcagagatagtgaggtctgaaagctgccctagccttgcatttttcttttctttttcttccccattttatccccttatctttctctagagtattttgcatggcacagtaacacgaaagctctcgttttgaactcataatgctacaattccgggtgggagatgctctttggggagcggcatctgaagggtctctcatctaggagtaggcttgagccacgggcaccctcaacgggaggctcattcagaacccaccttccaccttatccagttgcctgagcaactgaatagaagcagagaaaggagagttctgcacttgcacgagaatttgttcgtcttggaaacgaaatccaagaagcctaaggctcaagacctgatcctgaccgggtgtcacgtcgcctgggagcaggcgatcctgaccgggtgtcacgccgcctgggagcaaccctgggcctatgcactcttccctccatccctccgaggccgcggtaattatgaaaggaagtacggcccgctcgttctctgtgtggtttgaggagccaggaagaattacattcattcatcctttcctcattcagccagcatctgttaattacctacgaagtacagagatgcgtaagacatgacgtgtgcctgcagagtttctcatcagggaggccatgttagcgacgtgtctcccaaagcccactgggtcaccccattaaagcaaaaaccatgcactgatcatgcccctggggaagctgtgctgcttctcaccttcatggttttgagagcaaatccttttttggtatagaatcgttttgaaactgtttacttttgaagctgacacgtttgatacctttcctaagctgtgacggactgtaaatctctccctttcctccctggttcctctctagaccttcctggtgccccatccaacctggtcatttccaacatcagccctcgctccgccacccttcagttccggccaggctatgacgggaaaacgtccatctccaggtggattgttgaggggcaggtacgtgtgtcgttagactgggagctggcatttgcgaagagcagtgttggggcctgtgaatgagtggtacccctgcagatgatggcttggggtgtcggggagatgggtgtgcttggagagggagaaccaggggctggagatagcccagataccagggcagaatgtaggaagacaaagaacaagatgtcaggccggggtcctaccaggtgataagacaaggataagaagggttaaaatgaaagttgtgattcaaaataggtacccaaaattggatagtgtcgttgattgagtttttaaaaattctatatcacaattagctactaaatatactaataggattaattgcttggtacagcttgtgtgtcattagctatgcattcattcaacaatatttttagagacgattgttctatcagcaggcactattctgagcacgggggctattgcagtagacaaagctggctgagtttctgctgtcgaggagaaaagtgctgtctgggaaagaaagacctccagctgtgggaaagctgttatatttgagggacagcgaggagggtgggtgctggagggaggggagcaagccctgcggtggcagggagtgagtctggggagagctgggggcgggttccacaggacttgagagagtggactccgccgagagacttccggtccgactccagctgtgcaagtgctggagcacgcaggggtccgggacagtgccaggcttgaataggatcatgctggcattggtgaagccgtgcaatctgccacttccatgttccaataaaagcaggaggaaaaagataaagggccaaattatgaggagtagtaaagtttcaaaatagttattatctgtagtaaaatccttgtggttttcatgactgtacttatgctatactgcaagacgatccactcctggaaattggccgtaaattagggaacaaatcctatctacctcttcaaaagtttcattaagcaaacatttctgaaagtctaaggaggatcctgaaggcgcaaaccatctggatgggactgacccacaaatggggctggaacaattatttacttaggaaaaatagcagtagagccctacctcacatcatcacacaccagggactgttgtggcgttgagggggtggggagggatagcattgggagatacacctaatgctaaaagacgagttaatgggtgcagcacaccaacatggcacatgtatacatatgtaacaaacctgcacattgtgcacacgtaccctaaaacttaaagtataataataataaaattacaataaaaaaagaaaaaagaaaatcagtcttcagcaaatgaagactaaattgatgaaagcaaactttaaaacgcttaggattaaatataggacaagaatcacaatgtctcatgaaaaccaattctactattaaaatccatctgcagaagtagccaggcaatacttttaggcccgcagaagcacgcgctgtggtctttggtgtctgacgatgccgcatagctgaggccaggaggcagcgctctctgcaggctttagaatgtggtgttacgctagggctaggcaggccacagcgacagaaacgccagcgtcttcagggctcaacatacaaaagctcatctgtgcatccaggcaggcctaggagtggatgacgctcctttggcccatgttccgttgcccagaacttgggcaacgtggccctgtgtcactgcaggagagtctgagagtgttgcatttcagctcatctgggagggaaagacaaggagtgatgtggggaccctcaccacagtttcttggccatagtatcctagctttatgtcatacaacctgtttctttaatttttttttttttgagacagaatcttgctctgtcgccaagctggagtgcagtggcgccttctcagctcactgcaagctcttcctcccaggttcaagtgattccccctgcctcagcctcccgagtagctggggctacaggcacccgccacccacccagccaattttttgtattttagtagagacggggtttcaccatgttagccaggatggtctggatctcctgacctcgtgatccgcctgcctcggcctcccaaatcgctgggattacaggcatgagccaccgcacctgacctgtaaagaggttttacatttttaatgtaaaacatcttaaatatatgcaaaaggaagaatagagtaagccctcttatacccatcagcaaaagtcaatgatcctcaagattttgctgcatccatccatccctggttttttattggcgtattttgaagcatatttcagaccacatgtcacttttcccccatacacatcacacatgtgtctaaaatgcctgttcacatgccaatatggatgaatttcacaggcataatgtttaacaaaaggaaaaccagacccctgcttggagcatatactgtgtgattccatttatagaatgttccaaaacaggaagaagtaatctttggtgttggaataacaggttttcctgggacccttgtggttacttaccgtgggggtgacagtgactgggagggggccacctgaggagggggcgtctggaatggcaggagtgctgtcttttgatctgggtgcttattttgtgtatacaccagtcgtctgtgagcttgcctgtatgtcttacttcagtgaaaactttggccaggcgtgatggctcacacctgtaatccacactttaggagaccaaggcaggcggatcacttgaggttgggagttcgaggccagcctggccaacatgtgaaaccccatctctactaaaaatacaaaaattagccaggcatggtggcgcacgtctgtaatcccagctattcaggaagctgaagcaggagaatcgcttgaacctgggaggcggagtttgcagtgagctgagatcatgccactgtacttcagcctgggcaacagagtgagattctgtctcaaaaaaaaaaaaaaaagaaaagaaaagaaatttttacatgaaaatatggatgtcttttctcatgataccattgtcacacctgataaaattattattatttttttgagatagaatctcactctgtcacccagacaggagtgaagtggtatgatctcggctcactacaacctctgcctcctgggctcaagcaatcctctcatctcagcctcctgagtagctaggaccacaggcgtgtgccaccacaccagctaactttttatatttttggtagagacagggttttgctgtgttgcccaggctggtctcgaactcctgagttcaagcgatctgtcagcctcggcctcccaaagtgctgtgattataggcatgagccaccgcacctggcaatttgaacattttaatatcatctaatagtcagttcacactcagattcccccaaattttccaaaacatctctttacggtggttttgataaaagtaggattcacgcagggttcacactattcattttgttgtcatgtctctcaaattgttaaaaaaaaatgttaacagctttattgagttgcaattgacatacaggtttaaactgcatatatttaagatggacagtttgacagcttttgacttagctacacatatacacacacctgggaagctgtgaccacagatgagataatgaacaggttcctcaccctcaaaggtgtccttgcagcccccactatccctccctaccaaccctccccgtccccacaaccactcatctgcttcctgtcactataggttacagctctgttaatctagtggaatcccccactcttttcccccatgcagttgcctcgttgagaaaacccagccagtcatcccatgggacatctgcattggagatgcacctggttacatccttgtggggtcacttgacctgttcctctaccccgtttgccctgtaaactggaagttcattgcaaagaactggtagattccatttccactcctccctccctccctccctccctccctccctcccttccttcctttttgcctccctcctcccttctttccttcttctctccctcccttctcttgtccctccctccctcctttccttccttccttcctccacccctcccttctttcctccctctctcccttcacttcttccctccctcctttacttcctccctcccttctttacttcctccatccctcccttcctttacttcctgtctccctccctcccttctttcctccctcctttcctctctccctcccttccttcctttcttcctctctcccttcctctctctctctgtctgtctccctccctccctaagactgcttccctgttactacagcagggtgggggcacgtaggtctagtcgccccactcagggatgctaagttgggtggcagagcgtagcagcctgatgcctaccttgtgaatttctccatcagctttttatctaatggtctcatccatccatgatctttgcctgaattaattatgttcttaggatattcaagatgataattttatatttctatcagtctttcctcatttagctgttggaactctaaaaagaagcatctctgctcatccctcagactatttagttactctcaaatgcaggaaggcagaataaatgcttaattcttttcccttaattaccagtttccagggtgaggaattggtcccctggttacttccaatgttaaatagatttttctttctttttctgtcttgtgatctcttttgctgagtatcatcatgaaagcataggttcttacctgttcagtgggtttcagtcacctgcagtcattattctttttgaacctagaattggcctgtctttggcctagggaggctttcgtatcctggggctccggcatgaggctccactctttgatgacttcctgcctcaagctgagatggagccatgcctgcagggccttggtttcatgagtgtcaaatgctgtttaaagacgataacctgagcaccaaggtggatctcctcgctcccagctggtccctgcttcgacaccttcccagtagacagaacatattttctgaagcatcatgagttcatactgacgtttccaatgaaatttcaggttactgaccttaaatgtatatgttatgttacgttatgttatgttatgttatgttatgttatgttatgttatgttatgttatgttatgttgttacttaaatgtatattttattttattttattttatttatttatttatttgagatggagtttcgctcttgtcacccaggctggagtgcaatggcacgatctcactgcaacctccgcctcctgggttcaagtgattctcctgcctcagcctcctgagtagctgggattacaggcgcccgccaccacgcccagctaatttttatatttttagtagagatggggtttcaccatgttggaccaggctggtgtcgaacaccttacctcaagtgatccacctgccttggcctcccaaagtgctgggattacaggtgtgagcccactgcgcccagcctaaatgtatattttaaatatattttcccttactctaagactgtgctttttaggactcctaactcgattatcttctttatcctcctattgtattaagaggttcaacctgtggtctgtgaatttgcctgtgtatcttacttatatgaaaactttatgttaaaacacaaatactattaggagtttcaaaattataatctcagtggtatgactaacagagactactgaatgaaatttaagtatttgtccttaaaatgtgttataccatggaagtgtaatatattcagtttatacctacagtttatattcagtttataatatatttagtttatacttacagtatacaagtacagttgcagtactgttctaaagccactgttcttttctcattgtggttatctcgatacagatttaagtgcgttcatttcaggacttgttttgtttttttgcttcaatttttagcactgactttctttaaaaatcattttacattttttttatttatttattttgagatggagtctcactctgtcaccgaggctggagtgcagtggcgtgatctcagatcactgcaacctccacctcccgggttcaagctattctcctgcctcagcctcctgagtagctgggattacaggtgctcgccaccacgcctggctaatttttgtatttttagtagagatggggtttcaccatgttggccaggctggtcttgaactcctaacctcaagtgatccgcccgcctcagcctcccagagtgctgggattacaggtgtgagccactgcacctagctcattttacattttaaaaaattggtggaggattttaaactaattcttgaggatataactcatttacacgatctcaaagtcaaaactatttaaaaagtgacattcacagaagtttctgttcatttgtctccttaccctgttgcctgtctgccacatagataaccatatttattagacttttggtttttcctttttctttttctttctggcaacataaacagctctgcgtatatgtgtacttcctctttcttccacggaaggtggcatattgcgccttgctgtcttccggtgacagcacatcctgaatacccctgggcatcatgtgtgcacttgtcctttcttctcacacctgcacaggtctgcccggtgtgcatgagctggggtttgtttatgtagctagtcctctgctgacacgcattgggatgtgtattagtattatatcactgccataacaaatcaccaaaaactgagtggctgatacaacatacatgtgtcatcttctagttctgcaggtcagaagtccagcatgggtctcaccagagccatgtttcttccggaagctctggggatgagtcagcttccagggtcattcgggttgcggcagaattcagtccttgcagttgtaggactgaggtccccatactgtgctgtcagccatggtcattcccagctcctggaggtcaccacggtctgtggctcgggatccccttccttcatcttcagagcagccggggcaggtcaagtcctctcagactctggctctttcctcctccttccttctcatctctctggcccactcttcagcctcccacttccacttttaaggactcctgattaccttgtattcacctggataacctccctgatgtaaggttcttacccttaatcacatctgcagagcctctcctgccacataaggcagcgtactcatgggttccaggaattagggtatgggcatctccagggggcctcattcagcctcaagctagttttcagccttttgcatagtcattttgtatttttgccactgtatctttgggggagattcccaggcatgggttggctggatcacaaggcaaatgcacatgtaaacttcccagacattgccaaatccctcttctgcagatggtaacatgttgcattcccagcagcaacatgtatatattttttgccatgcaaaaaaaaaaaaaaaattgaagtctaatttatgactcctttcttgcatgcctctggtttttgaatcataggcagaaaggttttccccactttcaggttctaaaggaacccaaccaattttctggtttcatttttacatttagaactccatccatttggaactggttcttgtatatggagtgaggtatgaatccattttcatcattttgcaaatagctacgtaattgcctcagtgccatttattaaaatgaccattttttttcctgatttgtaacattaaattctcatacgcactttggtctatttctgaacttttcattctgttctattagcctggttattcatgcactaattccacattgtttacttagagaggctttaaactatgctttaatatctggtgaggcctgcttccccataaccaatgtgtgtgcacagacacacacgcgcgcacacacacacacacacacgcattgcttgactttcttaggattttcccggccactcttgtggacatctgatggtgttgaatctttctgttcaggatcatgctacctcttttcacttgtttaaatctacttttctcagctgttttctcttggagaagcactgggctctctaatcctgccttcacctgctctcaaaaaggcaggaaaatgaggggcgatcaatatacctcaaaagctgtaatgtgaagaatacgggctttgagtcagacagacctggttccccccttttttagcacccctgtttcccagctctgtagacgtgcttcttaacttctttgtgagcctgaatttccatctggagaatggggtcagtagtaccatctgcaaggttgtcatgaggattaactcacgtatggctattttaaatgatattttctgcctgtgttgtttgcataggggaacacaattgatttttaaatatttttgtttctttaataaattcttctgtgttctaagtgctttcacaactatgaacacgtttaattctcataatggctctctggtggctgttataaccccgtgtcacagatgagacatcaaggtgttggattacctgccgaggtcacacagccaagccatgaagccggattggagcctgcaaacctcggaagtctgtggctgctcagcctggtgtattggtgttacagccagaaactttgggaattctcttgttagttggttagttttactgtaattttctataaagaattcatatcatctgttaatggcgacagtttttgtttcttcctttgaattttttatattctttctttctcttttttgtttcttcttctttgagtattttgtaatcttactgggagggctaaagcgtcttctatcatatcgaattgggacaatgatagaagacaatctttgttttgtcactctaaagaaattattgtaagattttatcatcaggtatgacatttacaccattgatgtaggctttttaaaaaatatatccagcctgtattgggttaagatgattcttttctgatcctgatttcctaggagttggttttttttttttaaagcataaataaatttaattgcatcagactattttctcatctattgagctgctcatttggtttttctgatttcatctgttggtaaggtggttcacactgcccttctgtttcactattccggagctcctgagacagaagcaatttggtcttgatgtttgttttgtttggggttgagattgttgtatccatgttcataagtgaacttggccttttctggttgtagatttggcctgggttttaagatcgatagtgtattttctcaccagttttcataaacacagtttggattgagcttgtgttccttagccctcaggcagaggactctcgtgggcatctgcacaatgaggtcactcaggcggaggtgagacccttgtgggcatctgcacaatgaggcccctcagagggaggtgagaccctccctcaggtggaggtgagacccttgtgggcatctgcacaatgaggcccctcagatggaggtgagactctccctcaggtggaggtgagaccctccctcaggcggaggtaagaccctctctcaggcggaggtgagaccctccctcaggcggaggtgagaccctccttcaggtggaggtgcgaccctcgtgggcatctgcaggatgaggtctctcaggtggaggtgagaccctccctcaagtggaggtgagaccctcatgggcatctgcacagggtgctcagtgcctcccaatcctgccacacgttgtgggtgtggaggcgcccagaccccgactcagttcatcagaacccctggggcagaggctgcagcactcttccatttgtgaggcttggaaatgacagatctgcatctccgctgagggtcccgcctcagggggcctctgtgctgggccttggaggcaagatgtgctcaggcagcctgtcccgggctgctattctccagcagttcagaggttttagtgctccagggaagaatgaacggggcaagcttcctgccttccccatcgtgggcttgccccttccccaggcctgtgttggttgcacacctccctgggctgtctctgagtgtccagggcagggaagctccgtcacgtggagcccacgtgtgggtgactccctggggctgcctgactcctgggccagctcacagcctgcagccagtggttaaacatttcatgtggaatttccaattcccttgaagggtaatctttccctttgatttcaaaagtgttttagaaactatagacaagccttaagaatcctacagagaattcccctccacccaaaggcctcatccatgatttgcccagttttccccaaaagccctcggtaacaaaaggctccactccaggacatgggctgcacccagtggtctcctgtgatctcagttatttcttgacttctgtgaccttgacaattttgaagactacaggccggttatttccctgattcccctcaatttggatttatcccagtgtctttaggagtcgtcctaggtgacgcatttttggccagaatgtgggggaagtgatgctgggcacctcctgctacaccttgttgggtttgacttggccttggcatgtcccgttgttagtccagttattttgctaacttgactgagatttctcccctctaaaatgaccgccacttctgcaccacccactttacaattaatcagtattttgtgagaagatactttgagattctttaaaaacctcatttctctttccagtctcatccaccagtttgtcatccattaatatttcttgctggaattaattagggcaatgagggcaccagtgattttttaaaaattcaatcatttcttctacatttatccattggcctattcctgaaagcaaaagctttctcctcatttatttttccattaattatcatcagtgtggactcatgactttttattttgggtaacagattttaacccattgctatcattgctaattttgatgctcaaacttccctccatttggcgatttgggggtggcggggagcccatccagctggcttctgtattcttttgatgtctccatcattctttgagcacttccttatcttctggcacaagatgttcccaactcatcttgttctttctctcttctttcccagccatttctccagggaaccttgggttagtgcagtggagagtgggatttagaaaccaagatccaggcagtagtgtgctcattgctactggggcatcactgctcccagctaggaaatgtacatatatctatagctaggtcagtttctatatctagccacacatactgaaaagcattatttcacactatcacctccaaatacaatgcaaaaccctcagtttatgtgagcttcccttttctacatctatccgagcccttctctggctcccagtatgctcagtatatttatttttttgctgaattccactctatgtggccagtcttatgatcaaagtgggctgctgccctgcttggacaccattctgcttggatgccttctttgcccagatcctgacccctgactggactctttcactgctgcccttaaaatttttgcatataaactgaagttatcaaagtctaacatgactgcactatcttctttccaggacttaagtacaggacttaaaaattcctgaagtccagtcaagtcatacttgttatatgtccagcacatcaactctgcctcacttttctatatctacaaaggcaatgatccttactggggcattctgtctcacagtgagtgctggcttagatttctccacatttgccattttcttttcttttcttttttttttttttttttttttgtttgagacagagtctcactctgtcacccaggctggagtgcagcatcaggatctgggctcactgcaacctccacctcccaggttcaaatgattctcatgcctcagcttcctgagtaactgggatgataggcacgtaccaccacacctggctaatttttgtatttttggtagagatggggttttaccatgttggccaggctggtctcaaactcctgacctcaggtgatccacccacctcagcctccaaagtgctaggattacaggcgtgagccactgcaccctgccaacagcaaggtatgcttttaacaatgatgaatgagcaggcatctctttaaacaccttctgagggtgtttcactggcaggccagtgtagataagagctgctgttcagccttctacagactcaagcagaatatactccaaccctctacatcaccagccaacacctttacagctccgtccagggaaagaacagttctgcagccccctcttctcattcttaatgccggaattctggccacacgttcttctggggaactccacactgcttctctccacgtgccaccttcctggccttcatcacattccatggatcatctctgactcatcccccaggaaagacatcgtgacaagcagcgagcagaacaaaaccgtcgggcgtgtagacacaagcagcacaggctttgggatcacagcgacagggcccggaatcccagctccatcactttctagctgtgaggctttagggaagtcttttaggtcatgttctttagccataaagccctaataacagtgcctgtctcacgggtgattgagagaactagaacatggtgttacattgacttctgctttctgtcaagcttgagcaactttacgaatgcatctcctctgagaaacctgccagcccctgaggctgtctgtggctctgtcccagcctccctctgtgctcgcctaccccctgtcccgtggtcctcccaggacgcctggttctcattccccagccacttctctgagaatgtcccatgggctccctggtccaggcaggctccagaggcacccatgaagcccagctgtcctaaactccaggcagcggggcccttgaggctgtgactagtatagatgaggcctctggggcctcctatacctcaccccctttgaatgggatgcaagacaaacccaggccttctctgctgtagggagactccagggctgcctctcacagcctctcacccgggaagcggttgttgactcctagtctgtgcctggccctgggctagaatttggggaggagaaagactccggagcacatggtctagatacaaagtcattaatcacatagaagccagggaggtgatgtcagagaggtctgctggggcgccgggaggacactgaggaaggaacaatagaacccatcagttgggtgtggagggcccaggaaggtcctaacagccaagccccgtctcgaggctctgtgaacgtgagcccaggcggagagcagcagagcagggcagggacgaaagctcccaccacaacactctctgccagaagagtgttcacgtttcttccctttcatctacttttcaattgtatcttctttgcagaaaagtttcctttagatgctaaccatttttaaaagtgcaccaagaaggttttattacttagagttaccttcagtgaattatggaatgaaggatcctaatcattggaggaacccattgaaaggccctataataagttgatgctcagatgtgggttgccaaaaaaaaaagcagcagcttttataggtatttctggctcagtaatgctttgcttaattagtaacctttgactgtagagtgagcaaaacatctctttgagcatttttatggtgcaccataaaagggagaatgcaaatgttatatgttttcatttgccactcctgtttgtctgctcagttacctctgtaaacccctgccattcgcagccatttgctgtgctctaatagccaaaataacgtctagtcttctcaaaagcctgccctgagcagagttttccataatgaagatgctagtggtaacactttaggtacagctaaaactgttttcattctgaaaatggaaagcaaaaaaaaaaaaaaaaaaaaaaaaagtcccacttagtgcttatttgtgcataatagtagccattttcttagaagaaactgttttagaaagtgttatgggctaataaagcacaagtctgtttagtgctggtctctctgtaactaaagagtagtggagatggagcagccgggcgcccaggcgtccccaggacgcttagagacgccgaggctgccggcggcgtcgacagcgacagcgtttggaatgacgcatgcctcggtgaagtcgggggcgtgaagcaacactgtctctctcctaagcacacgctgtgccgagggaccggatcctgggctgatggatgggaggccacgggctgtgtttcattttgctgtttgctgaggcactcacctgcgaggacaccttgcaggatgtatggggctttctgtttctctagcacgtccttggtccaaagcctcttgcgatacacctctcccagaggtgaatcctggggaaaatgtcgtctcagcagatgagtgtatctgctttccctagtcagaagttgaagcccatacaatccgggggcagtcccctttttgcctaaacggccagggtggttttttttgtgttttttgctttttttgagacggactctcattccgttgcccaggctggagtgcagtgatgtgatctcagctcactgcaacctccgccttgtaggttcaagcgattctcctgcctcagcctcccgagtagagtggctgggattacaggcacctgccaccacacccagctaatttttgtatttgtagtagagagggggttttgccatgttgtccaggctggtctcaaactcctgacctcaaatgatccacccacctcggcctcccaaagtgctggtattataggtgtgagccaccgcgcccggcccagccgggggtttgaaagccaaatggattgccctggaattccggggtgggattgcccttccacagaacttgcttctgctctactcacccctccaatccccatgtgctgacattcgctgtggtccagtgctgtgctaggcacaggggcctctgaggaaagtacaaggagaacctgccttcagtgagtaggaaagagagactcaggaaagaagcaagataccaagacctcatggcaggtggccatgcctcagagggagaagcaaaggaccgggacctcagaggaggtttcctttattgttatcaaaccggacttgtggacctccctggcacagcaaagccaaaccattgacatcgggattgcagcgagagaaagtgaggtgtgtctttcagggcaccaggccaggagaatcgggtcactcaagcctaagacctgacctctcctatggcttacagtaaggatccataaaggcagagaggcagaggcttcaggcagagtcaagcatcaggacacggaggtgacacattggttttacctaaaaggacatcttaaagcaggaacccacaggttataggtaaattcaaagattttctgatctgtgatcggttaaggaggtgaagctttgtcgaaacattttggatcagcagaaaagaacgttagctctggcctgagggtgtgacttcctccaggctccttaggaagaaatttagaacaaacagcagaggtcagagttccatcctcagctcctccatatctgaggtcttcctcacctcccccacatctgagctcttcctcagctcccccacatctgagctcttcctcagctcccccacatctgagctcttcctcagctcccccacatctgagctcttcctcagctcccccacatctgagctcttcctcagctcccccatatctgaggtcttcctcagctcccccacatctgagctcttcctcagctcccccatatctgagctcttcctcagctcccccacacctgaggtctatgtgtagcggacctgcatagccaacccatttggtgggagtccgggtttctgaaaaacaactcagggacatatggtaagatgtcactttagtttctattgggaaccaagcatctcctgactctggcttccttggctattgttttcagctactttcaccttcttgtttgtcaagttgctcctttatttatttatttttaatttttatttatttatttatttttttccgagacggagtctcgctctgtctcacaggctggagtgcagtggcgcgatctcagctcactgcaacctccacctcctgggttcaagcgattctgctgcctcagcctcccaagtagctgggattgcaggcactcgccaccacacctggctaattttttgtatttttagtagagatggggtttcgccgtgtgggccaggctggtctcgaacttttgacctcaggtgatctgcccgcttcggcctcccaaagtgctggcattacaggtgtgagccaccacgcccagcctcgctcatttacttctcagggctagctaggtgcctggaatttcccttgaaggaactcaagatttttctttatttccatgtttgggggcccaccagtccctaagaggggttcctgctccatctcattatgaggatcttccttggaaaataggcagtgtggacatgtgggtagaaacctgtcctgaaatgtagctgtaaagcgtccactttcctgtgcatgtcttctctgtgatttgctttcctctcttcaaaagtccacagtgtttataagcacatcaggcaatgtcaaggcttagaaatcccagagtctcctggaataagacactcagatcccctcactctacctttactgctgccagcattccgtctggaaccaggcctggctgtggcagggcagagccagctctgggacctgcatggatttgtgtggccacaggcaaggccaggggaaggtgaagttattacctggtaaaaccagcagaagagaggaactttaggcaccttagcaacgagccaccctcccggcaatggttgttaggggtgtgggggatggtcactgagagctggctggttggcagaggatggagaacagaggctaggggccaactataccgggatgggtcgtgggacctctgtaagcctcagtttcttcatcataaaattcagagaccagaagttcatttaacgctttagcatgggactagcacatattagacatttaataaatggaagttcctaataataaaaataatgaagttaaggcaagtgtttagcatccaagaaggctgcttgagacactgtgaccttcagaggaaagacctccttccccagagggaggcctgtggagtgtgcagggccctgtcctagaaaatacctgggaaaccaagcagaggccagcagggcaggttcaggcaagatgagcgccacataggagctgagattcaggggccggggacactgaaacccccacgggggtcgctgtggtcagagaacccaggtctgcgaagtccccagtgactgtaaggatctgtagcccaggaagaggcagcctgggctcaaacacccacagtggcagtggagagtcaggctggagctactcacagtgcactcgagcagaatcacaaactcgcacagcttgaaaatggcaaatgcagcagtccccagctctttttcccggtagaaactgactttaggaacagcaaggaggcttctcacccagcacactggttcccaggcttcacccagctgggcagagggtcaggagcagcccatctctgcagaggcattggcctgttcctgccccaccccacctcgcagcaaacaaagatggcaagacggcctgggccgactctgggtgaggggctcacctgggtcaggaagcagacagctcctgtacggccaggggctctcaggttgctgtgtttggtacagtaacgtcctgtatttattttttatgtggttaccatctttgtcctcccaggaacacaagctcagtgagagcagggactttgtctgagcagtgccgcatctccccttggcacccagaacagggcctgctgcatagaaggaaggcgtcatgccaggaagcgcctgtgagcaggtggacagggcatcgcacacatgccatccgggacagacatagccccagacagatatattgggccgcccaaggcccaataaagtttccaaccttgattgacttcactgtccacctggccacctgttacctctgtagggagaaattctagtgtgcccgtctcctgcaggttcataagccaaatgcttttatctcatcacttcaagatctggggctggggatttctcatcactacttctgtctcctccttccctccttatggaaggacgtgagacctgtctgtggccctttggataagtatctgtcagcatttcggtcataataaaccctgactgtagttgaatttctttttcataataggaggaacaagagtgacattatctctgaatagtcattcgcacatgcacaggagagctgtcattggccctaatgactccttccataatcccacggtcatctggtaaatttgccgaaacgggcctcattttttgttctggtgtaatgtctctgcctaagcgtttaggtgctggggagacaggtgacaatgacatacatactcagaaatctcagaatgtttcttggttgctcgactgtccataataacaccctcacagtggcttttctctcttatttctcaaccagcatacaaaatctatatgagatgaatggtggaaaaggggcctttttgttcattcatctgtcagatccgttgaggtcctattatgggacctttaaaactaccacaggagaggaaaatactgccgcatacgtgacaactcaagtgggaccaaaggaagtgttttaccacaaatgtcattttcgaaaaatagaggtcaacgtatatataaatcacaaccgtcaaaccaaattaaattttatgagactcatatttccccgttctttccgaggaccattccctgctccgattccttcatcctaattctcttgttggatttttttagatttgcctgtgtgtttcatttttccagccattaggttttatatttctttccttcattcgcccattcacccagcagacacttattaagcacctactgttttatagattttattgttccaggtatcgtgctacagattagattactaaggtcaaaaccttttagtttctccctccgagaattcacaattttcaggaggagggatgtgagagggaggatggaaatgtactcggttttttcttttttttgttttgagatagggtctcgctctgtcacccaggctggagtgcagtggcacaatcttggctcactgcagcctcaacctcccaagctcaagcaattctcccacctcagcctcccgagtagctgggattacaggagcacaccacaatgcccttttttttttttttttttttttttttttggcagagatggggtctccctatgtggccctggctggtctcaaattcctgagctcaagcgatcctcctgccccagcctcccaaagtgctgggattacaggtgtgagctactgtgcccggccacaaatgtagtctaaattttggtacacatgagagtcgtgagaattgttgtaatgatctatggccaggggagtatgtgaaagcaaatgagtgagcagggtcagccaggaaggctctgcagaggaggtgagactcaggttggaccttgaaggggacacagtctttcgatgggagggaagacattccaggcacagagaagagaggaatgaaaggctcagggttagaaagttgcacagcacctgtcgttttaaagtatagatcttatttttattcgggaacggtgatgccaacagatcgagagacaaatggcattggaaagacagtttgttgctgacagatcccaaggggagggggcagggaatgccacacagggccatgtgcagaagcaccgggtgggtcaggaggcagaggaggaggggactgtggcaggagcctctgctgtggcttctgagggaagggccgggccaggcaaggttaggactgcctggtgtcacagtctcagcgggctccggggctgggggctgttcctgctgtcagatgcccagccccagtgacaggacagaggcatgaagccctgagtgtgagcgctcacagaggatgaggtgggactgggctctaggtacaaaaggtactacctccaggtgagctgcttgctgtctctgggaactggctcaccctgggagggccatctctccagggccagccaggcccaggtgtgccaggtccagtggaagtggtggctaatgcaccgtgggcagggccaagcaggcacagagtggggcgtgtgtgagcgggatgtgatgggagatggcccaaggggagccgcagctggtgggaaaggccatgcttgggggctggcttgtttttatctaaaagcacccctaagaaaccgtggctgctggtcaccgagctcgctggcatgtgccggagtgtccggggctgacctcgtcccactgggggctcttgacagccctttagggtgaccactgtggtcctcgctatgtggacaggaagtctcaggagctcagtgtctctcgaacgtaggcccagccaggcctcatgccccagagattttggccgaggagccactgctgctctcctcacgccccttcctgggcaacggagcagaagtcctcaccagcgtttcaggaatttagaaatattagcagggaatcacccaacatgtggcacagggagtgtcaacgtccctgtttccccttgagagggatcagatctgatgggagggagggacagatgcggatggggaggttgcaggactcagctcagacacggccctgggctcctagggcaggggccatggggggcagacatggcctccaggagaagggctttatgaaggagctggttccttcagggcatggggttgagcgggaaggctgtttcgggggacacacttgggagatgtgaacaaactggccagaatgcagagagcacagggggagctaaggcaggcaccaggcgctgtggactgagcgtgcccccaattcctgtgctgaaatcctcacccccaaggcgagggtgtcagcaggcctttaggaggggatggggtcatggggtggagccctcaccaatgcgatgagtgcccctctccttccaccacgtgaggacacaggggcatttggccatccccagcctggaagggagtcctcaccaggacccacccaggctgaccccctggtcccttcagtcccagcgctgtgaggaaatgaactcccattgcttgtaaaccacccagtctgtggagtgtcatcacagtcgcctagtggggaaggtggtgtaggagggcaccaggcacccctgggcctggagagggaggctggaccgctcggcacagcaagagccgtgaattggagtcgggtgagatggatgagctgggggcctgtgggttaacaaggaccccagactcatctgcccctccttccctgtggctgtgagccccaaggtccacaacaccctgaggcctgccccaggctgaaccctgcagggtgcgtgacgggggaagggaggcctatgcggaggtgcacacaggggtctcctttaggccagtgctctccgcactggttgccagagaggccgccttgcctgggccccgaaaaccaacagctgggcagccctgaccctttggtttgtttgttttaaggtagcaaggacacttgcatttttttttttttttttgagacggagtctcgctctgtcacccaggctggagtgcagtggtgcgatctcggcaagctccgcctcccgggttcacaccattctcctgcctcagcctcctgaatagctgggactacaggtgcccgccaccacaccacgcccggctaattttttgtgtttttagtagagacgggagtttcaccgtgttagccaggatggtctcgatctcctgacctcatgatccacccgccttggcctcccaaagtgctgggattacaggcgtgagccaccgcacccggcggaaaaatttgcattttttaaaactcaccgatctgtcaaaatagttcaagcaagaggttgggagcttctacatcagggtcctaccactgaaatcaagcaaatgtaagagaggctgtggaggagaccccaccatgtgcagcaggggaggggtgacagaaggagcactgaccctcgatgacagaggacgatggtgtcgtgaccagaaatagagccttccacaggcggagcccgtcttgggaggaagatcgcggttctggggtgaggctgtcacatgtgagctgctggaccccagaagcgtctgcctgtggtcggtaggaaggaggtcccgcacccaggtctctgtctccttgtggagggacaggaagggccctaggaaggaagccatgcaagagagaagaaagaggaggcaaggacacactcaggagggtcagagaaagggccagatggggagtggagggagatcgagagagccagcaccccaggaacccaagcatggagctcaggatcagggaacaaagcccatcactccacagcccttctgcctctgaagatccaaagaatattaaacaggaaagacaaaacaaacgacaacccggaaagacagaagtccccagggaagggctgggaatctagagctgggctgattcaaagcctgaagcttccttgggagtgaagataaacgcagcacagcgtcgagtcccctgccggcttatgaggtgtgcaaactctgcgatttgtttgagggaactggcctctgggccttcctggtttcctgtgcctttaccagaagcccccatctgtccctccctctgcaggggccctccagccacctcctctcaggaggtttcatttggctgtggtgggcacggggaggagccgtcagaagcaggggtactcagtgtctgtggaagttgctagacgtgcaagttttcctgctgacaccagagtttcagccaggcagggtgcgcttggcttggcagctttccatggaaggggttctggagcatctttttctcctcctcttagctctggatggaggggggccacctcctcacgtccctcctcccttccccacacgcagctgcaccttgtctgcttcctctccatgtgcagaattacctttgggatgaggttaatgactctcctctgagcagccattgaccctggcctccggagtgctgagctcaccatggccaccagagcctcccagcaggggtgttcctggtcctgccctgcccaccagtttccaccagtttttccagaggccggatctcatgtgcacaaacagaccaagcctcctggcccactggcgccaaaccccggccagacctgggagtgggcaagctggggctgcgtggcgggcggcagcatccccgtgggtataacagacagacagctcccctaatgggcctgaaggaccgcccctaccgggtggcatttgaaatagatgccatttctgcctttgtccgaaatatcataaagtactgtttattagccttaaaaaaagttaaaaaaaaaaaaaaaaaaaaaagccgttcaaaatcccggcttccccacagagcttttttttttggagacagagtctcactctgtcacccaggctggagtgtagtggtgcgatctcggctcactgcaagctccgcctgccgggctcacgccattctcctgcctcagcctccagagtagctgggactacaggcgcccgccaccacgtccagagaattttttgtatttttagtggagactgggtttcaccatgttagccaggatggtctcaatctcctgaccttgtgatccaccttcttcggcctcccaaagtgctgggattacaggcgtgagccaccgcgcccggccccccacagagctttgatttgttttatctttaaagaattctgcctccctctacatcagcacattgttagtgagcacccagttgcttctagaacattctttcttggccttgaaatctaactagagagccagaggagcccagccagggttaaagaactcctgtctctcacgaaaaaagagtcctggtctctccagacaaaaatgtaaaccttttattatagaaatttcagtttctcccctagaggtcgctaagtgtagttacatttttggtgatcatctgttttggagctccgtgtaaagcaacccattttcagtactgatttttaaatcattcgcatgttcatttgtaaattcgttaatgcattaaacaccaagttgaggctggaccctgggagagatgctggaggtgcagggatgcgtgagaccctgaccttgcctcagggcaagtccacaagcagccagaagtgatgacacatgtggtgagaggactcagcagccgaggaggagtcagtgccgtgggggtggtgcgctccagcagggcttgccacactttctgtaaaggtcccgatagtgaatacttgaggctttccaggtcagacgctctcagttccagctccgcagttcggctgcaaaagcatgaaagtggccagcagccgcacaaaccagtgacagtggctgtgttccaataaaactttatttacaaaaacaggaagtgggccagattcggcccctgggccggagtttgctgactgcagtactagagccctgcttgtttgtgtttgagacggggtctccctctgtggcccatgctggagtgcagttgcataatcaccactcactgcagcctagaccctcagagctcaagcgatcctcctgcctcagcctccagagtagctgggactacaggcatgcaccaccacacctagctagattttgtatgttttatagagaatggggtctcaccacgttgcccaggctggtctcgaagtcctggactcaagcaaacctcccgctttggcctcctacagtgctgggattataggcgtgagccactgaacctggcctagagcctgctttaataaacctgctaggggccatcacgttaaagaaggtaattgtgtttgacttactgtttgttgatttggcccagactctgtgaagttggatgctacctcatagaagattgtaagttgcaaagccagaggtcacggttatattgctctcatagctggttttatttctaactttttgatcttattgagcattctttctttcattcactctacatactttgacatatattcccctccgaaccagttttaccatcttactagttcctcattaatgagtgaaataaatctttgacacacactatatatttgtatgagaatttgtatgcatgtatgtatttatttatttatttttgaggcagggtctcactctgtcatccaggctggagtgcagtggtgtgatcatagctactgcagccttgacatcctgggcgctaatgatccccctgcatcagcctcctgagtagctggaactatgggctgtgccaccatgcctggctaattttttttttaattattttgtagagatggggtctccctctgttgcccaggctgattttgaactcctgggctcaagagatcctcctgccatgtctcccaggagctgtgtttttatttatttatttattcttttgagatgaagtcgcactctgtcaccctggctggtgtggagaggcacaatctcagctcacagcaacctccacctcccaagttcaagcaattctcctgcctcagcctcccaagtagctgggattacaggcatgtgccaccatgcccagctaatttttgtatttttagcagagacggggtttcaccatgttagccaggctgatcttgaactcctgacctccggtgatccacttgccttggtctcccaaagtgctgggattacaggtgtgagccaccgcgcctggccaggagttatattttttgttttttgtttgttcgtttgtttgttttagatggaccttcactctgtcgccaggctggagtgcagtggcatgatctcagctcactgcatcctccacccccctggttcaagcgattctcctgcctcagcctcgtgagtagctgggactacaggcacgtgccaccacacccagccaatttttgtatttttagtagagatggggtttcaccatgttggccaggctggtcttgatctcttgacctcgtgatccacccacctcagcctcccaaagtgctgggattacaggcgtgagccaccacgcctggcctgggagttgtgtttttaaatgaatgctttgacagtgatctgcactgtgctgggggtactctgaagagggtataggagtacagaattaggacatagattctggcagcctggcaggggcagtgagaggctaagagggatgctgttcagaggcttccgaaaggcccggatgctctccagattccaaaggagtcagccagttgcagagaggaggggtggaaggagcagacacactctgagagggggaagagtggtgcagggggacaggtgttggagactgcgtgatgcctccaggtaatgacaaaccgcggctgcaggaggaagtgcaggcagagcctaatggagccatgtggcacctgcctgggttccccaatcatttggcacctgttccaatcgacatctttcaaaaagggagaccaggcactgggcgggaagggcagggtagtttgaccttggctgccaccttcagtggtccacccttttcccaatccattgatcctggccctgaaactgttttatgctcagcaaaacaacagccctgtagataaccagacactcgctgctcagaaggcaggtgagggggtcatctcatggagaatggccacagggcctagcaatggctccctcctcaggctctcctggtgggaaaggatgaagtgaagtggagatcagccgccccactgtcccccgtttcttttttttctttcttttttttttttttgagacggagcctcattctgtcacccagcctggagtgcagtggcatgatctcagctcactgtaagctctgcctcctgggttcatgccattctcctgcctcagcctcccaagtagctgggtctacaggcacccaccaccacgccttttttgtatttttaggaaagacagggtttcaccatgttggccaggatggtctcaatctcctgaccttgtgatccacccacctcgacctcccaaagtgctgggattacaggcgtgagccaccgcgcccggccagcccccgtttgtgaccgtgcagtggtttcccagcatctctgcagagggagccgcacgcccggcgttctcagagaaacccgatgagcctggctgcctcttgctgtgctttcccccactctcctgctctctcaacgcggcgcgtgcctttctctcccgggcagcctcccgggccttactggttctctttcgttcctcttggtcgtgggggtggaacagccctgaatcccagagctactgccctgaccaccgctgaccccgcagcagcccctgtggctgagagcctgccctgagtgcccagtgcctgaacaagatgagggagcccacagggtcaggaagcccccaggcctcaggtgaatgcttctggggccaggaaagcagccagacagactgaatccatacatgccgagcatccaggccagaggagggcagggagctctaggcagagcccccgcccaggaccccagcgttcctcagtcttgtttatttctccctcaggcagccgaatacacacatccagggtggggagggtggggagggtggggagggtggggagggtggggagggtggggctgcaggggccaaccagaggaaggagacctggagtcgcttagcaaaggtgaatgagcgtccgcagtgcagcttggggtcttgagagtaagttgaacccgccaggcgtctgtttccccctcacacatgcacagaccaggcaaggacccggaaggcaggaggctgccgggaaaagcgcccaccggtcacttggcaccgtgagctacgcacgtgagccacgtgcgccctgactgctggctctttccttagtgcttatacgtgattgataaaaggtgctaaattgacggcctgaaatggaagtcatccctttttcttcctttcttcttcttttttttttaaacaaacaaaacgtattctccatgaaatcgcccagtgctttggtttaacacccagaggactggtttcactaagaggagcccacctaagtcaccgaggactctgaaaccgctaaaccatgccacagggccagcattcaacacggaggcactttgcacccagtaaaatccaactgaaaaaatgtggggcttggtcctccgcactccccagtatctggtcccagcccgcctacgacccccatctcctcccctgagacattgcccaggcagccgggggcctcccacggaagcctgagcagctcgtcttgcttgcccttccctctgtgctgtggtgcgtgttctccattacctggaggcctgtaaggtgtcgtgagctgtgccgatgtgtgacaaacatttggtgaccttgaatgaatcactctttttctgggcctcagcttctttcagcgtaacataggctggaataatatcctccggcttcctagcttatgggtgggcccatttatgcatcagctgcatagataaatatcgcacggctcctctccactagacactgtgccggggccagagctttcaagccaacctgagtgagctcctctgagatccccggatcgtgaagttcattctctttttgcccatcaggattggatggttccagtctcagcattgtgctcctgggtcctttccctcttcacagacgcgatggaggaaggcagctgccatgggccctgatgggggatagggaggcctcagtcctgtctgactcaagagctagtccaaccccaggttcgcctagacccttcccttctccaagatgagtgttctgtggaaccttaatctatccacataactcttgttttctgtgtctctgaagtgaggatttgagggtttcgatggctaccccagtgctgagaactggctcactttggctgaagtgaggatatgagggttttgatgtctaccccagtgctgagaactggctcactttggtgccaggggacttgccccctttgcctctggctgtgcaagctgcacagtcttttcctaattacaccaccctgtggttttgccgacttccggggtattcattatctacgctgacctccagctcgttctctaccaaatattttggccggtcattctacatttcattttattgtttctttttttcgttgaggtgaaattcacctcacataaaattaaccattttaaagaataccattcacaacttagtagattcccagtgctgtgcaaccaccacatctgtctagttccaaaacatttttatcatgccacaaagagacctcatacccaatagcagtcacttcccatcccctcctctccccatcccctggcaaccaccaacctgcgttctgtctcaatggatggaaagatcctggacatttcgtaaactggaatcgtgcggtgcatggaccttgggtcaggcttgcttagctttccatcagtcatgttttgagatttgtccatgtggtagcaggtgtgggtgctttgttcctttctatggctgaatcctgttccatggtgcagagtccttttgtttatccactcagtgctgggcgtttgccttgttcacggctttgactgtcgtgactagtgcactaggagcatgtgcctgcaggtatctgttaagacacctgttgtctgttctcttgggtcagtggctgggggcggagttgctggcttatgcggtgactgtgtgtagcttttggaggagccactgaccatgtggatgttttcagctgaaagcgttgagagttttgcgctttgcctttcgagttctctaggaagcaagccaccagcatgcctgcttacacagtctcctctgcatccgtgtcgccagtttaccaaggtcattttgaattctcctgccaccctcccaagacttagccacccaccaccttggtttcctctgcacacttagtgagcacgtttcctatcctgtcatttaagccacttacgaagtgttaaatgcaccaggccccaggccaatcccactccagcagccagtttgtcctgacatgctctccatgcttgcagccggccttctctgtgtcccttgggtcccccagagccacacggccacacgaaaccagagtttgcttgtgatggggctgcagagatctccaaagatgagctccagggctctcctggtgggcacaaggccgtggctgtctctcccgtggctccctagctggcgcagcttgtgtggcaccatcaagggggagagagggacgtggtcagcttggggcagtggcagtagaagcggcactggcactcgggtttcttaagagcacaaggatgagtgagaggtggggctcggggtcagattaggggaaatgaaaatgctactgagcagggagatggtgtggagctcccagacagggagtaaaattagcacgagacagaccatggggcaggagcaaagactcgggagaggaagaagctggggaacttggagggcaccctgcaggcatcgccagcagacccggaaaaggcaagtctctgttgaagggagtggctcttccctcgtcaacactgccaggaggcagtttctttaaatcttaaggggactgggcctgccgatctggcttccagggcagaagactcatccttccctgcctaaggaccttccttatgccgtgggccagcaatggtgtctgtttggtgtgtgtttggggcagaaagggttggggtcgaagctggacccccagcctgtgcccacagctctgtcactgcttaccatggtcctggccaagtcttcctctctaggctttctctgagccctcacttgtcaaacaggaggaaggatgagatggtatggaaggtcccctccatcactgatggcctccaagccctcagaggtttgttcccaggggtttcactgtttgggtccagtccttctgtggcccagttcttgactgtgagcttttgactaaaactcacccagacttgatggtgggcatagcaagagcctgtatctccaaggcacaagagggggttgtgcaggactcaacttgtcccaggtgtggggacgccttgcagccctgcccagctcaccaggtaccagcaggtgcacatggtctacatggcagcctcagtccctaaggcatgtccagcccatctcagtgtctccctctgcacaggtgggagctatcggcgacgaggaggagtgggtcaccctctatgaagaggagaatgagcctgatgcccagatgctggagatcccaaacctcacaccctacactcactacaggtgagaacagcagtgataagctgttacaggaggaaacactggcagcccaggcaggtgccttctgttggcaatagtaaaacccagtcgtacgtatgcaaatcagatgtttcctagtggcaataacagtacctaaaagccttaaggagcaggcgggatgcatagcttggtgttattccaagggagatgataggcagatgttagactcatgaggctccttctatcagtaccagctggcaaaacaccccatagaaatggcccactgttattatattaggctgaataaccaagaaccacaggcagcagagatgtggcactttaccaaactccacaacctgttgggactattaacgtgccgtgtgcaaacaaagcagatgtcctaggaagatccttctgctccccttcccaagcagggcccaggagctgctagtctcacttatcaagcaattaacatgccatttaacctttagcttcttgaaccccgaaactgatccgggcagtaaatccttggctttaacaaagggtagggtgattatgagctgttagtactgtgatcacttcccgtaaggcctttgaaggagatggaatttccagttatcaccagatgttgagtttgataatgtcattgttctgccaggatggaacatttcatacgattggagaatgaaagaataggaattagtaattcagggactaaaaggtgaaattacatctttatgaagaatttttctttccggcacaaaaccaaagttagagttaaaaaaaaaaaacaatgagagatgctatttagcttctattcattttaacatccttcaggagcttagaacagacaaatcaggacacaatacactgggttttaaagaaaaacatttagcttaaaatgagctgttgggattcaagacttaccatgtgaaattaactgaagctatatagttatttcaaagaacagaaactgtaagtagagatcagtgtccctgtctgaaactcaggtacatttggggaaacctctatagtaaatgtatatgtgcatacttgggatatttttctagtatgtaaattgaattcaaataattgtttatgtatgtgtaaagaagagacagaactgaaagcattcctgtagattttagagaacattgaactccaccttcattttatagttaaggaaacggagatcatctgatttgctgtaagtctcacagttactcactggatggaatcacagagtgtggtgtgagcggatagaggcctcagttacctgacaaagtttattctgccaaggttgaggatgcacccgtgacccagcatcaggagatcctggcaacatgtgcccaaggtggtcagggcacagcttgcttttatacattttagggagacatgagacatcaatcaatatatgcaaggtgaacattggttcagtctggaaaggcaggaaagcttgaagcaaaggcaggaagactccaagcagggagggggcttgcaggtcacagataggtgagagacaaagggtcccattcttctgagtttctgatgagcctttccaaaggaggccatcagatctgcattgatctcagtgagcagagggatgactttgaagagaatgagaagcaggtttgccctaacgcagcttgcgttttccttgtagcttagtgatttggggttcaagatattttcctttcacccctcattcttctcctgaaccaacagaagaagagatgcagagtgccgttgatcatttaaaaggctggacttcaaaactgccctttggtagtgacatcctgatattccaattctgtcccatagctacttgcactttaacccctcgaggttatcctaaacttgaatcagggcaactgatgacatcaatttctggacacccaatccatccaactagatttcacttgcaaatttaaaattgttgagttgcaactgatgtacctgtacctttctttgaagtcttttaggggaaaaagggcacatatgcaatttgcattttttttttttctgaggcagagtctcgctctgtcacctaggctggagtgcagtgacaccatctcagctcatgcaacctctgcttccctggttcaagccattctcctgcatcagcctcttgagtagctgggattccaggcacccgccaccacgcctggctaatttttgtatttttagtagagacgagatttcgccatgttggccaggctgatctggaactcttcacctcaggtgatcccccgctgcctcctgcctcagcctccctaagtgctgggatttgatcccccgccaccgcctgccttggcctcccttagtgctaggattacaggtgtgagccaccacacctggccacaatttgcacttttaatgaaaccaggtgaaaagagggtgtccttgagcaatagcctttatgatatgagtagacacctatctgagccctcccttgagaaacagtcagcgcctttgtggtttcgttcttttccttcttacctttgctttgccgtgactctcatcagtggtttttcctttagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtggtgagtgggggtgagaagggaggctggaggcacacgggtcctgagtgagccagggcacacactaatccagggcttaggagtttcttagtcacgcctttgtcctagtcaaaactaatctcatcgtcaaaccaaaaagtattgcattttacaattagtgttggatctcaggccagcccaggagatctgattaattagtagcattactcactctcttcttggaactgaggaatattccttggggcaggaaagctgggggtgcctcacaccagaactctaagtccttaagctaggtcaacatggaaccaatactcaatatttgtaagagagccagcctgatatttaatcagaacatttgcccacaaaattaagccaaaatgtattaaaagaaattatatgcagccaaagttactgacagggtttcatttaattcacagaacaaaagtttcagggaagaataaagtagatccttctaagactatttcccccaggaacacctcctccacggagttggcctcacagggcaggcccatcccttacaacccgtgagggtggcagttctgagatgtcagctcatcgcgactcctcgttccttcctagcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcaggtgaggggaaggcgattcccatcctggagacaccgcattagagatggggctgagtgcccctgagcctccagatcccaggctagtggcgtctcattggcctgtcccacttgtgtctgtcttggagctttcctaatcccgggtttggccagactcggcaggaatttctgtctgatttcattagggccccaagccattcattggaaactggtgatgatttccaacaggggatcgactcacattactgttttctaaattagggataattttcgctaacgatgaaaagcaagaatgtgtaaagttcctatggggaatctttaaaatacaaggtattcaggaccttcttgtcacaaattaatagacgtagtatgttaagtaatctagcctgtggtaataaataggcctctaaaagtttaattgcttgaacataataggagtttacttctcactcatattgtggtctaaggtgggcgttcctgtttggcgggtggctctcttccacaaggtgattcagggacccaggctttaccgttctgtgggactaatctccttctgcacccagctgccagcagggaaaagaaggcaaagaatggacctcttcagacctgttcaggagtggaacgtcactctgttcatcttcttggggctcagtcatggggctctgccagttgccaggaagcaatggagcagtgtttttggccaaccttgagcagacctctgctgccctgtgctaatgctgaaagtggctgcctaatcttctgggctttgtggactaacttccgctggccaactgtgggtcataggagcttttcttgcccccctccttaaatttttagaaacccaaaggaaggacggcaattaacgctcatgaaggactcactgtcacctgaccccggtcccttcagtctgatctgaattagtgaggttctgtctggagaaggaatgaaccagctgcacctctgccccaggcttcttggatgagagtcacagcttgtgcttgacagatggaggggctgttcattctggactaacctaggctgttagaaatacaacttaaattcctgacctttgtccagacatgggatgaggaggaggtatgaagggttgagatggtgaactgggtcagtggccagaggaaaagaacaagactcccccactccttcccccagggagcctagatccattttgcttattgatgtcaaaccctcttattcgctctcttttgcttctcttctctgactctctgcgttaatgagaatatttggctccattgtttttgctgtcgtagacatggctctgtttcctggagacagctcctgagcccagcatgagtcctcctttccttggggctcccagggcacagaatcgctcttgaagctggggagtcaagagatggccagggcctgcccacagctgtttccaccccagagtcctcggaaatgccccggatctgccctctctgcaacccagagcctccctgcttctgtccctgtactacaatgccgtgcaaagagacagtccccctgttgttgttttcagtagaaaaattaattaacttgctagatgctggaaactgccttaggagacacagttggaactcagagtgactttgatgggaaatggacagaaagatgagctaggaagccaagtgcgtgacgggtatcagagaaaacctcgcacagtcagcaggaggaggcggatgacgtgggggcacaaggcctgttggcatgggtggaggtggctttggggggctgccatcctcaggacagaggagtttaaaagggaggaaagcatagacacttggggggcccagggctcccgggcctggcctgtctgctctaaagatgaagagggaaacatagaaggtggtgccgaggtgggagggcagcctctgaggacagctggagtgaggacgcagatcagctcccagcaataaggaaaggggacttggagccctgggcggtgccaccccctcacctcttcctaatgctcatcttatccgtgccaggtgctgcaatgggtgcaggtattcccaacaccacccctccaccctcgagacagccaggccggggtgaggagtctgcaccctgggcttgggtccagcagcgcccagcacaccgagggcaccagcacgtgcccagtgcatctgcacgtgccacccgctctgtgtgccacagcgtggaagggcctgggaagctctggataaaggctcctctcatcctttcttgctcattccccgggtcccgttggtgacaggtctgaacctgccgccacccttgtaggttactgtaatgcacagtgggttgcaatgcacagaagccccctgggtttcctcaatgctggttaactttcagccaccagcaccaagccaaagctcctgtgccactttgtggctttatttcttcctactcttctcagagggcaggaggtgagggtagacaggaggactcttaagcagtagcagggagaagcagaaccatggccttgtgggaatgctgttagggcgtggcgtgaaccctggagcccaccaatgagagccccggaagagcagccgtggtgacaaccagtgtgcttctgagaggaccagtgtttcaggatggaactgcccaagcagcagggctgggcccagtgtccctcggctctccttcagactgaagctttcattacgttccaaaggaaaggtggagacgcacccacatgcagcctgggattgtggtcacgtggatttcaaaaatctctgttatcttcactgtctgaatctttgtgacaaaggagagaacttgagaagttcagagggacagttctaaatccagtaaaaggcaggccaagaaaatagtttttcagaattaaaacttctgccataaccaacaaaaacttatggataaaatataactttctggaatcttaaatgtattggccaggcagggtcctcacacctgtaatcccagcactttgggaagctgagtctggaggatagcttgagtccaggagttcaagaccagcctaggcaacatagtgagaccccatctctacaaaaaatacaaaaattagccaggtgtggtggcatgcacctgtagccccagctccttgggaggctgaggcaggaagatggcttgggcctgggagtttgaggctgcactgagctatgatcgcaccactgcattccagcctggccaacggagcaggttattatgcctctaaaaaataagtaaataaatgaattcatcaacacactcataagaaaaacagggaaatcctcaggtgtcagaggcataacaggaactagaaagagttcagcaggaagtgctgggctggtgccgcagctgccctgggtgggataggatcaggttggatctttcctggtggtttcaggacctggggtaaggagtctgcaccctggtcctgggcccagcagtgcccagcacactgtgggcaccagcacgcatccagtgtgtctgcaggtgccaccgggaactgtagatacactgggcaggccatgcagtaacatgagagtcagctttgaatctgtgtaagggaagagttagggcctaaactcctgcagttgagacacggctcttgaaggcctttccctccttcctaggagaggctgaaactctgcctgcagaggtttgactgtatgtctacctggactctgagtagagaatgaaaagtcagtctgagccctgtgcccagctcaggactgggttttgaatttgcattatatggatggcccaggaactcccagaacagaaattaatgtaacatttggttccagaaaccaaaagcacgagcaactaaagaaaaagtagatacattagacctcatcagaatgaaaacctttatgcttcaaagaatgtcataaaggaaatgaaaaaaactccccaaatggaagaaaatatttgcaaattatgtatctcatgagggatttatatctagaatatataaagacttcacaacaaaaagacaaatgacccagttaaaaactgggcaaaggatcggcatagacattcctcccaaggagatttacaaatggccaccaagcacatgaaaacatgctcaacatcattaactgttagggaaatgcaaatctaagctgcaatgagataccacttcacactcctaaaataagatggctaaaataagaaaagttggacaataacaggtattggtgggcatagagaaattggaatgcttgtacgttgctggtgggaatattaaatgattcagaaacgttggaaaacagttggcattcctcaggaggttgagcagggagtcaccatacgacaaagcaactctactcctaggtatgtacccaagagagcagaaaacatatgtctacacaaaatcttgcacataaatgttcatagcagctttatccatagtagccgaaaagtggaaacaaccaaaatatcactcagttgacaaatggataaataaaatgtggtctatgcattcaatggatgattcagcaataaaaaggaatggaattctgatacatgctacagtgtgggtgaaccttgaaaacattaggctaagtgaaagagaccaggcacaagagaccacatattgtgtgattctatttgtaggaaacatctagaataggcaaatctagagaggcagaaagtaaattcatggtttcctagactaagagagagcatttgagaggaatgggaagtgatgggtgatggaaacagagcttcttttggggatgatgagatgttccaaagttcatcatgatgatggttacacaactctgaattcactaaaaaatgttgaattgtacaatttaggggaattgtatgatatattaataatctcacaataaggctttaaaaaaaaagctcagccttcctgagattaattttatacagataaaatgttattaaaataagtatgggctgggggctgtgattcgtacctgtaatcccaacactttgagaggcagaggcaggaggattaccaggagcttaagaccagcctgggcaacatagcaagaccccatctctacaaaataaaaataaaaactatagaaaattagccaggcatggtagcacatgcctgtagtcccagctacttgggaggctgaggcaggagaactgcttcagcccaggaggtcgagcctgccatgaactacgatcatacccctgcactgcagcctgggtggcagagcaagaccctgtctctaaaaaaaataataagaatggctcatagattgtacactttgcgtatggttggaaggcccagaaaatctgtgtgtaatatcttcttaccctcagggaaaacagtgatcaactcttcctgaaatagttacatatcataccccaataaaggattttactctcctccaaaaataaaacaaaaagaaaatacacaaaaaactaaagaaacatggtttcaggccagaccatctgggcaatcaacagaagcaaaaatgattcctctctggagagatattgccaaagccaaattatccaaaataaaaagcctttttaaagatgaatcacaattgtcaagcacacaggcaatgatttgccatgagtaaaaatgaccagttttaaaaaaagagagaaagatagagggcttcaattacattaacatacatacaagtctgagagaaatatataataactacatttaaaattattaaagtcttagtaaaataaagcgttaacattttaagtaaagattaaggtaccatttcttaaagcagatttgtttttagaaaaaataaatgggacacagtcattgaaaatgaaagcagtttagacactgtcaaaaagagaattaccaaattaaaagctagatttgagtaaataactcttaaaacaacataaagacataagattgaaaatagagattaaaagacttgaagaacagaatgagatctaccacatagctaataggactcgaaagaggaagcaaatgagagttacaaaatacacagagataatagccgagaaattccagggttgatggaaagcattatttacaagactgaagaaacaccaatcccgagtggagtaaataaaactgaattcataccaagatgtatttgctacaactgtaaaatgccaaagagaaaaatcttaaaaacaattggagtgaaaggcaaataatcacaaaggcaagaccatttgactgaggtgactattcaggaacaacagaggccagaagacaatgggataataatctcgaaggagctaaaagcaaataactgccaacctcaaattttatacccagataaactaatcttccaggattttattcagaaaacagcaaagtaaatgctatataaaaatgaagacaatttaatcaaaatagatatattgttttgataatttttcaaataatactcttttttttgaggtggagtctcactctgtcacctgggctggagtgcagtggcatgatcttggctcactgcaacctctgcctcctgggtgcaagcgattctcctgccttagcctcccaagtagctgggattacaggtgcccaccaccatgaccagctaattttgtatttttagtagagatggggtttcaccatgttggccaggctggtcttgaactcctgacctcaagttatctgcccaacttggtttcccaaggtgctgggattacaggcataagccaccacacccggccaagaacactcttttaaaaaaaaaaaaaaagaaagaaacctatggcaaaactgctgatttgagactcttttttttttaaacaaacatttccagctgttgaaaacctatctttatagtagtcaagagaatgcagaggataatattttatgtgtaaatgtattccagggtttttcttctgactttgttttttttcagacaatcttgtatcatcttttacacaagaaccctgaggagactttctctagcgatgttgtttatttttgtagatgctactgtgttttaattaatattgagatatagattttgtatcaaaagaagcaagtggatttacctttgtcctagctgattgtagcatgtatggtgatacggtttggctccctgtccccacccaaatctcatctcaaattgtaatctccacatgtcaagggagggacctggtgggaggtgattggatcatgggggcaatttccgccatgctgttctcatgatagtgagtgagttctcacaagatctgatggttttataaggggctcttcctcctttactctctcttttctctcctgctggcatgtgaggaagttccttgcttccccttcaccttccatcacgattgtaatcctgaggcctctccagccatgtgtaactctgagtcaattaaacctctttcctttataaactacccagtattgggtatttatttatcacagtgtgaaaatggactgatacatatggctagaggggaatcacatagagcccttgcagaatcccctgtatcagcctcactgtttttctgttcatagttcatgttctgttcacttgttcagaggattttgatcaagagtaggaattgttcttgcaactgaagctttgttttgtcagttattacattctttcttattttgagggttatagcttatggaagggtattttttagtttctaattgaatgtgtgtttaattagaaactggtgcaacacatattgctctgggaaaaaaagttttggttcacgtgtttccatcaaaaattttataattgggttattgatcttcatttcaagatgtggatgattcagattctggacatgttgaatgctggaataacgagctcccagggacccctcttagaccagtctctcttctggttggtgctggtgctccatctctgcccgtcctaccacctggggaatctcaggggcccagatgctgcaggacttccgctccccctccttgtgtttagctcatcagaatggagatttcacagccttcttctctgggaatctccccacctctgactggcaaggccctcccaggtgcagcagttttgactttgggccttccctggccctactaacatctgaaacttactctccccagcagaaaactcgatccttttttgaaatggggggaggcagggatgagatggggaggtgaaggggttgccagggctgaatggtgagtggacctgatggagagggagaaggattggagagagaataaaacaactgccttttgtctgaaataagtctcccctcaatggaaatagcagctcctgggagcttaggaatggcccagtgtgcaggagtgctgaaaacacgcagagaacacacagcagaatgctcggagccacatttcaatgaagtttacagttttgaagtgcagtttaacaggttctgtgacatcttatgatatattatgatatattctaaggataaatgaggccttaaaaaccgagagagaccacatgaggaggaacagtgagctgcatagtgtgaaatcctacagaggggagagaaaaaaatgaaggagaaaagaagccatggaatggctttgtttttaatgaaaggggaattcccaagaacatctcaaaacgtaagatgtcaggttggaaagggagttgaatctacttcaaaatagatgatgggtaagaggtttctttttcaattcttgaaaactttgcaactccatggcagatcttgtcctcgtaggatttaaatgcgctgaaatttccatcctgaactctgccattttctttgctttagctgcctcacctccctatctccacgtgagaagttcagctgcgttcaaagccccgttggtgtccgaattgctgcaatccccaggttgccctctttctccagggacggggttggctctccagtaaatacctgctcatcccaccacatcttagaaaaacagctgtgatttgtaggtctatagggagaattgggcactcacagtttcccacaggaagcagttaaagattacagaagtagaccatttgtgttgctatgacaatggcctctctttttgcagacagggacagaggttttagaacctggtaccaacgtcttgggcatacagtgtttggtgttcttaccttattctaaatatattcggatacgttgtaggtttacattttttttttaatgttagtgccccctttagctcatagttgattcaaggtcccagtttatcaaacttttgtataaaatgagcaatgtgcaagccatttcctggtaacagccatggtggcatttaagacaccctatgggagctctgtgcaggcccagggagcaggagtgagccgggtggagccacagctggaaggcaccagggacttggggctgcatctgtgacaagcccccttcctctttggagaactgagcaaacttcacattgcaagtattccctttccgtgacacctctctactcaaataaatggatagtatttcatagaagcactgagtaactgaatgaatgactctcaactgacatatttgggaagattggactggctggcattatctccctccaaaaatagaagggggctcacagtgtttttatagtgacaggcatcactgggggttttctattttgtggacacattcactgacctacacccagcagccgatctaatgtccatgcagggaaggtgctcagcatggtagggggagaagggaagggagagatgctgcctcccagggctctcaggatcagggagcgtgccccttcctgggggcaggcatcccaggcctttgctctgcaggttcctctgtggtttcagagaccccacagggtgtggtgagggttgcggtgaggccactgactcgcgtcctgaggcttagtcatcctcagccgctggccctgttaggctatggcctgctttggggctgtcctttctcgcccctcccttgtctagggaaacacctgtttgtggtggtgaggcgagaagcttcccacacagcatgagaacagctcttctaggatgcacatgaaccctggcattgtcttaaagactgtgttcgtgtcatagcagaatgccccaaacggggtggcttaaatgacagaaatgttttctgttaccattctggaaggtggaatctgagctggaggtgttggcagggccatgatccccctgaaagcttgggaaggatctgtcctgggcccctctccagcatctggtggttccgtggctcggacagcctctctcccatgtccccacagagttctccctgtgtgtgtctgtctcctcccatggcactctccctgttgtgtgtctgtggacaaattcctttttttatatgggcactagtcatactggatcaggggcccaccctatgcagtatgaccgcatcttaacgagttacatctgcaacaactgtgtctccaaataaggtcaccttctgagataccggaggttaggataacaaaataaggattcagggggcacaggttcaagccataacaaagatcaaactactctcgtgtagaaaatcttgcaattaaatgtcataggttgcattattgtgcaagccccccaccatgttactttctgtcttcagactaactaacagtgctaccctctcagtctctgtgtaatgaggaagtctgaatgtctgaaggaatagatgagtgaatggatggatggataggtgatgggcgaatggatggatgggtggatggtagatgaatggatgggtggatggatggatggatggatggatgggtgggtagatggatggatagatggatggatggatgggtgatgggtggatgattggatgtatggatggatgatagatggatgagtgaatggatggatgggtaaatggatggatgaatgaatagatggatggatggatgggtaatgggtggatggatggatggatggatgatggatggatgagtgaatggatggatgggtgaatggatggatggaaagatggaatgatcgatttatggatggatggatgggtggatggatggatggatgggtgatggatggatggatggatggatgggtagatggatagatggatgatggatggaggaatgaatggatggatgggtgatggatggatggatatgtagatggatagatggatggaggaatgaatcgatggatgggtgaatggatggatgaatgaatagatggatggatggatggatggatgaatggatgggtgatgggtgggtggatggatggatagatggatggatgatggatggatggatgagtgaatggatgaatgggtgaatggatgaatggatggatggatcactggatggattgattgatggatggatggatggatggatggagatggatggatggttggatggatagatgagtgggtctatgaaagagcagaggaagtcctcgcaagtgttcctgctacagaggtgcatgtgtgcatcctgctgttcttggagccctagtagggcttgtgaaggagaaggaaacagatgcttctactcacctctgtgtgccagtgccctaccaggcacctcagtgtttgctttcattctcactctaaaggctaggactggtcatagcatcctcctttcactttcttcaaaacaactagctattgatcacctgctgaccaacaagtgctgaccaccaggaggggagagtgagaagactcttaagtaaggaaggtaggccaggcttagcctttcacaagtgggacaactgaggcacaggtgatcagagcagcatctccagctcccaccctgagtccggccttactccatcactccaggctatttccctgggtatcctggagaccacctgattcaaaaggagactttgccaccaaacagtatcctcccagaacctccgttgcttcatctgcagagtgaacccccgaatgggatatggtggacttgaagtgtctctcctcctttttcaaccatgggggccctgaagtatggcgggatcttcagtcccagctgagagcagctcctccatgctgtttataaacagggccttccctgactgctaggggctagctcaggtccaggttttcctatctgaatggtgtttgaagtttaaatcggtccacaagaaaattaacaaagcaaatggagattgtctagaatataatacccttgtttttaaagtttcactgcttttatacatattatatctgaatcagtgcaaacatatcaagacaaattagttcagtgatgttgtacacagaagagagatttcatgaaagtaagaaaatgatcttacatgtgggccgggagtggtggctcacgcctgtaatcccagcacttgggaggccgaggcggacaaatcacttgaggtcaggcattcgagaccagcctggccaacatggtaaaaccccatctctagtaaaaattcaaaaatcagccaggcgtggtggcacatgcctgtaatcccagctacttgggaggctgagacaggagaatggcttgaacccaggaggcgaagttgcagtgagccaagatcgcaccactgctctccagtctgaaataaagaaaagaaaattttcttacatgtgtatgggtcgagaatggcatggctggcctcggctgcccatctccttttagaaaaacattcattgaaatggatgaatgcgattttctcagctttagttttctgatcggtagaaaaggggtaacgatacctacttcattgggatcattgtgggattagatgcaattatgtaactgaaggcagttggcacagacaggcactggataagcacctagtcaacctaccctcccttccccttcttttgtgtaaatcctcacgcccccttctctcttcagcttctcctgtccctatcacagaataccacatttagagctgtcagtgaacaggcatgtgtctgaaagtcaggatttcctatttgagataaaagtctgcagtttccacaagttaatacagcaaacagaccaagcatcttttttttcttgcttggtggactcaggtaaaattgagctgctaagtacccaggatttatggaatttgttgctaatattaaagagatttacatgtccgttatactcctgtaggtttaatctgatcactacaaaatgcttagaatacgttgctatttcaaggacaacttgattatttgggtgaaagctggatctttgtatgtagacactctagattttggatgctaatctacttcattggttctttgcagttccttcagccgcccctgagaacgtgtcagccgaggctgtcagctcgacccagattttactgacatggacatccgtgccggaacaggaccagaatgggctcatactgggctacaaggtgtgtgatcacaggatgacctccctttgcttaaagagtgggctggggaaatgggagcatgtgctattcccccaaagcaacgagcttcctcttctcctacagatctgcagcgtcagccagtttgtgatttttattaagatattcagttgtcttatctaagcctcattgcagcctgggaattaggcatcagtataactatgacacaaatgccaaaacagggcaccagaagaaaagcacagccggagtggaactgacctccgggcctgcgcctgactctgccctcgctggcctcagtgccgcgggccagttactgaagccctgtgcttgtgtctccccgcttgtaaaacgggaataacgatggtagctttgtcccagggttggtgtgagaattcagggggtcttttacacagcacgccttgctcatgtgaagggctgggtgaggtggatcgctgtgtgcatgtttctatgtgtgtcatcacggtcctagcaatggcatccgctggcagggttgaatctgtcccagcttctctggggagccatttctgggttccatcttccatgcatccaccccacccctttaaaacccccttctgttcctcgttccatcactcggggcgacaggctctgtctccccatctgctccttggctcagcaatgccaagcatcagaatgagctgtttcggacccggccagcgaggccacgcttgtctcagtgctgctccctgggttttgagcgtgcctcctccacctttccgtacttcacatccctattctttgttttccccgcctgctctcccatgtcttctcccttccccgggtgttctaagtgcgccctgctggctctgtgacacatggcagtcccgttgaggggattcagtgaccaaaacttcacaccacattcctggggccccgagaaacgcgcttgctgtgctattttcaaacacctccctgctgatgctatcctttatggccttccaggtccccgatctcagggagcagttcagagaaggtgggcattgagtgaggtcttagcaggaggccctggagcagagcagcttggggtggggtgccctggaggagagcatagaggagagcagcttggggtggggtcccctggaggagagcagcttggggttgggtgccctggaatagagcagcttggggtggggtgccctggaatagagcagcttggggtggggtgccctggaatagagcagcttggggtagggtgccctggaatagagcagcttggggtggggtcccctggaggagagcagcttagggttgggtgccctggaggagagcaccttggggtagggtgccctggaatagagcagcttggagtggggtcccctggaatagagcagcttggggtggggtgccctggaggagagcagcttggggtggggtcccctggaggagagcagcttggggtggggtcccctggaggagagcagcttggggtggggtcccctggaggagagcagcttggggtggggtgccctggaggagagcacagaggacagcagcttggggtgggatcccctggactagagcagcttggggtggagtcccctggaatagagcagcttggggtggggtgccctggaagagagcagcttggggtggggtcccctggaggagagcagcttagggttgggtgccctggaggagagcaccttggggtagggtgccctggaatagagcagctcggggtggggtcccctggaatagagcagcttggggtggggtgccctggaggagagcaacttggggttgggtgccctggaatagagcagctcggggtggggtcccctggaatagagcagcttggggtggggtgccctggaggacagcagcttggggttgggtgccctggaatagagcagcttggggtggggtgccctggaggacagcagcttggggtggggtacctacagcatgcacagctgcagatggcccaaggaggccagagctcccggtctgtgtgaggacagcaggtcttctggggcaggaaaccagcttccatggctggaaaacccagggggctgctggctcctgtggcaggaagcagagtgttgtctgtgttcataatcgagtctttgttttagtggctgtggttggcatggctgcagttgggccctcagatcttgcagattatgaccaggcagcaggctcgccaagccgtgggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 983 - DNA, 139315 bp, Homo sapiens
gggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 984 - DNA, 84914 bp, Homo sapiens
tcgcaaatttctgttttttttaatggaacaaatgcaattcaacattccaaagtaaattaagtcctcaatttgtattggtgctattaggttcttttcttgactggactgaacttagtagattctctcaaatacaaaaaggatttttagattacttattaaagatatatctatgcataagtggtaaatcagcatgcatataccatacagcaatatagtattaacaacccataggcactgatctcagacatcccaagtgcctatgggttgttaatagtactattaacagtgtcatagtactagtactagtaatagtactagtaatagcaatagtactagtactagcaatagtactattattattttaaaggtaaattttattttaaaataaaaatagtaatagtaatagtactattattagtgttaataatactaatagttaatactaacagttaacactaatagttaatactattgacaacccataggcactgatttcagacatcccatgcataccacttacgcataagtagtaaatcagcatacatataccatacagcaatacagtattaacaacccagaggcactgatctcagacatcccaaacaggctgataatgcaaatgattctttcagaaaccattgtatttaccttttgaagaaaatacctagatagtggaactgaacacaaagaattattaactagctgaaattacagccagggtttgagacagaaagtgtacattcagaattcattctcttaaccacaaaattatgctgccagagaaaatcagcaatgttaaacaagtagaagaatgttacatgataaaaatgcattttcagtaggctgtttacagtaattccaattccaaggtaaggttttgcctttttaagttggacggctgtgagtctaccacttggttattatgtgtggtgagacttcagaatatgaaaaaatgcttaagcttatgctttcatttgccactattaaagaaagaacagtagagtaattccataatagtactagtttacaattactttttttgtgaattagtcataggaaacttcagaattctgttattttcagggctgaggttgaattcatttgcgctttaatatcaactgctggtctttctgcaggcagtcactttcagggtagaattactgggtttcagggtagcttttcacactctacactatggccctggggatgggttgactaccaacaaaaggttgctaaactacttttttggggcatgctcagagttattgtccctttaggactaaagacgcaccccccacccccccccccgccctttggttgtaaatgttgactgacttcataaaagactccaaacagttgaaaccactcttccttctgcactgaagatgtttgcattgtttgttaaaatggattaatcagatttaaattttaaacaccatgtcctagaattgtaacaagctaattattccatttaaagtgcataacaaactaaacttcctgttaagtggcatttttgatccaccaattatctggacaaatatactgatggtcagttttctcatatgtcctgctttcaatttacttcatgattcaattaaacagttgtcagtacatgacaagaaaaataagctccctggtccatagtggccaagacatatcattaacattgatatctaatacacaagttattgcacattgagatatcttaatagttggataacattcttattttaaaacaatatgtgtggattggagattttgcaatctaggcacaaaagatatcttctgatcccttccgttattcagaaagtaattaaaatcaactaaatagattacaaagacaagaagagcaaaaaattgtaatctcctggtgaacatattatgaattggagccaattactggtatgcatttctattacccttggcctttgtaatctggaagctataaacttcaaaatgttcaattcagcatataagtcattatattagaaaattccatttaaaaacctatagaagttaaaatgatttaaatatagacataaaatagtaagcatgaaggtgttcaatatattaatcctgtaatctaaaatattatttgggcaatattcttaatctcttaaatattgattaaatggattttacaggaacaaggtaataaaatcatttttgagcagcgatttcatagttgtgaatgaaaatatgatgcattataaagtgcaagtgactccagcatcttcagaatgtgaacaggctcttgtcccccattgccgaattttacattcttcaatagatgattctctcccaaaacaaaacacttcattcagccatattggaccagtacctgcaataatgaggtataactgcattagtaagtttagagtttagtgtttctctttgagtggggcaaagccattaattccttcactaattaaacaaaaaagtgttgattattttctgtatgcaagttctgtgctctctagtaggaatcaaaaattaatctcctgcttcagaacactttatactctgttaacatgtaaactactaaaatgcaaagtaagaagagctctaacaaagttacctacacagttctataaaagtagagattaagaatgtttttttaaggatttgacaaattagttttattattaatctaaaaataaagaagaaagtttgagccttaataatcatgggtacatgtaataacctgatgatccaagcgtatctgtatgtcaaagggtcttggggtatatttgcacataaaataaaccggaaaaaggaaaacttaatatcagcatcttcctccttttgttatcttcccgtgtatttcaatttatgtgtgcctggtttatcaaatacattatctgtttttaattaaagtagaactaatctaatcagcaaagggcctacacaccatcctgtaaggaaatcatggattaagaatgctactgattgcaaacacaaacaaacagcaagaaaatgacaaagcaaaggttttcctgagctgatcaattgtaagagtgttaacagtaagttggagagcccaagtattttttgaggtgtttataacagtattgaggcttttttacttgaaattttaaggcagaagaaggaaaagaaaaaaggaatatgatctcaaaatcagaaaccttgccagggacactttttagttcccaaattatcttactaggcatggcatgtttcctattgtgtttgtgattgtatgtgtgagcatgtttgtatgtgtatacgtatttgtatatctgtgtttccttataagtatataaagtctataaaaactttttgaaagcctcaaagggctacttaaaaatacaggcaaataaaaacaattgcacaaatagtaagactattcccatgttaatacaggaggaagccgaagtacgagacatttataaattatatctattatatttattgtcatttataaattgtataaacaaacagaaattaaacttttggtgaaagccatggctctgtcataatttggagagtgcgagaatggctccatgaattgtgaacccgggctactgtgatgctttcgaattgtattttgtaggtctactcagtgaatttagatttcagcagtgcagaatttgtacaatccaggaaaaggaaactgagagtgggaattctcccaatgtctacagcaccagcaaggccatcccaacatgaatagcaaaggaaagaaattatttagttgactaatgtgctgacatgtaagcacatgtttttagaaattgcagtaagggaattcacgaatgttagaataccaaggttgtggtcctgataatgaaaatttaagtccagtcttttaagaatttcttatgtggcaggaaacacttatacatgtgatgtattattccatgcaatcctcaaataactttcaaaaactgaatgccattattgtgtcattttactgttgaggaaactgaaaatcagcaaggataaggaactgtacgtgctcaaagtcgcacaggattctcaccctgtatccaccctgagccactgccttaaatcaatgacttactgcaacctccttcattattagacttacttatttagcaaatctcctttggtgcctacacgagtgaacaagaccaaactccatactcttgtggactgacttcctgggagggcttatgttctaggtagatgaagcaactgagatcacatatacaatcatgccagagcaaatactggcatctagagcctctgattcttattctggttatttttcctctgaggacacatggatgtgacaaatgtattgtggaatttggtatctctgtcttttgctatgtggaacagtttcagacacagtgaaaattttttaagtgcttgtgtataaggtaatatgctaggtcttttcacatacatttctaaatttactttttataataaccttgttaaataatgataattatctccatttcatagatacataaactgagactgagaaagggtgtatgactttctcaaatttacaaagaatagatccaggcaacagaacatgatgacacttaaagcttagtgatattcatgggttacatagatgtctagatagaattatagaagtaatttccaaagatttgttgttttatttttatattaatatattcaagactattgagcccaggggaaaaatttatttaatacacattttccgtctcattccaaattgttttctgcattaaaaagttaatgcagatagtataaaattcataaaattttatccttgtgtaaaccaatgagataaaaaacaaatttgtttttatttctttagataataactgttattcaaggatcttcgttgttggggctgtcactgttattattttttttgtgcctctgaactattctttctattcggtggaaagctatacaaaaattacgtgtgtttcttagatatgtttttaatctctaatcctcttcctctctttctctctctctcatctttccacctatatacctagccatatatatatctatgatttcctttataatttgagggttgtagggattgatattgattatatattttttttaagtttttttttttttttttttttgagacagagactcactccctctatcgcccaggctggagtgcaatggcgtgatctcggctcactgcacttccgcttcctgggttcaaatgattctcctgcctcagcctcctgagtaggtgggattacaggtgtgcaccaccacgcccagttaatttttgtatttttagtagagacggggtttcaccatgttggccagaatggtctcgatctcttcaccttgtgatccacccacctcagcctcccaaagtgctgcgattacaggggtgagccactgtgcctgacctcctcttcacctctttttaaaaaatgaaagatactgatatttctttgggggatttgggtatctttaatcttaccagcatttccatgaaaaataaaaggtaatcagtttcatacatcatccagatatattataaaatgatgagatttgagatcagctgctgaatagataaatgggagagcaaatatcattaatagttaaaagtgcctgaatgtgtattttcattatttctagtcatgactgagtgacataaatttgtatgacttttaagcctagttgggaagtgttttgtgaacagtgtctccattgagaaaaacaatgtaaattaaagttgaaaacaccttgggaatcaaagtagagaagaatgggtcaatatagcctatagtttggattgtagttttgtgcttatagagaaaccactcatttttcctcaattttatgatatgcagaataaaggagtaaggctaacatagctttaagactttgtctacctttaatatttcatgatactaagattctgaagaagcaagctctttagaaatgaagatcttaagtataaaggacttggaaggatgttccatctggtggagaaagcatggtatgagagaaaggttaaggcatgaatcttgacccttcttcccactcccacccacccccaaccacccccaaccaccataatgactacgtaaatttgtacaactttgatgacctctgctagccctacttattttctctatgaaaaaaatatgctatttttctgtgattacccagctgtatggaccagccctatactactttccataatatttaacattcaaatgtttacattttaaaacattcaacatgcaaggagcagtatgtaaaaatttgacttgtgaccctttgatatatttatttatctttgagattatatttactcccattcattaagggatagttcagaggtatagaggtgcattttttgattgccttctgtttacccttacattttttttttgaaaatttcacatagaaaattgattatggtatgtaaaagtggtaataaaaaagcaaagaaaagacagctaagaataacttttaaatggcatttatgtttatatattacttttgtttctcttttcaggtttggagtttcagcactataaactcaggagaagaagcaatagttactccagatcttacttccctcatcagcatccatacaggctcagatatacctggaacaaattcttggaggtaccactgttgtatgataaaactcatccaagtttgctgcagggagaccacaggcacaatagctgggaaagcctggatacggggcaaaaagtgactcactctcctttccctgccctgtgcattgataaacagtagatgcccctcagtgcttccttaattaaacttgttttgtctagtcagaaaaaaaggtgcatccaaatgagagaacctatttaaaggagcatgcttgaaactttattcctataagtcattttacctgcagctgcaaaactaattgttcttaaaactaaggattctatctgctaagccaggtttgctatttaaaaccagaaaaaaatatgtggagactgtccaaaaattatattctttctataatggtgcattataaaaagagggttcatttaaattgttttctggctgggcacagtggctcatgcctgtaatcccagcactttgggaggctgaggtgggtggatctcgtgcggtcaggagttcgagaccagcctgaccaccatggagaaaccccgtctctactaaatatacaaaaaattagttgggtgtggtggtgcatgcctgtaatcccagctacttgggaggctgaggtaggagaatcgcttgaacctgggaggcagaggttgcggtgagccgagattgtgccactgcactccagcctgggcaacaagagcgaaactccatctcgaaaaaaaaattgttttctttttgtttcaattttggtaatgatgtacaatatgatatgaacctgattcttctcactttcctaagagaaggataaataattaaaacaatgcatgtttctcttttagttctttactcatccactcatttttctaagtttcttttcttgtctctactctgtatttaaaattgctttttcttttcctcttgagtgaaactgtgaatttaaggtggaggagtgaaaaaatcaggaatgttttaaatagctttccataaaaacctcgtttgccatgtctaatccccaatcagtgaataatgtaagcctgtctcttaaaatacaatatccagtgaagtagatcataaaacttacttttcaaatcattttcttcagaacaaataatgttggttctatttttttctctcagctcattttgctttattattttaaaattctcataattattctttagttgtttggtactgaactctacgcagggagtggaaacaacagctaagtcaaaccaggtgcagtggttcacacttgtcattccagtactttgggaggctgaggcaggaggattgcttgaggctaggagttttagatgagcctgagcaacttagcaagaacctgtctctataagaaattaagatttaaaaaaaaattagccaggtatgtggtgcaggcctgtggtcccgagaaactctgcaggctaaggtgggaggatcgcttgagagcaggagtttgaggctgcattaacctgtgattgtaccattgtattccagcctaggtgacagagtaagaccctgtctataaaataaaaaatctaagtcatattagtgggatatctactttgaattagccttggaatatcactgatgtcaatatacaatgtaatagcgatctcactctttcaaagagaatagcaaataaatgtgtgataacacagtttgtgttgctgctagcagtgatctccttcagtagtgagcaatacaacattgtgagtcagattttgtactgggtgctttccatatgctagttaactcaagcttcaaaacaaatctgccaggtcagtattattctcattttattggaaaggaaattgaaattctgaaacacaataaccacagctaaaatttaaacttgcaattttttaagttagaaaactcctaatctttccagtttgcttcactagatgctgaaaaaatgtaaaaggaaaccaaaatcctgacccactttattgtttgatgataataaaactctgggacaatgtatagaatcaccaactaccataaacaaacagcctcctgaaaatttagacaaattatgtcaagaaaacttgagagacttatctccacatagccaagtaagtaacttcacatgagactaaactctgtcattctattccttatttaagtttaaaaaaaaccattttcttcttagtatctcagtatacttattatcttcctttcttaccagttctttagaccagaaatccctactttatagagatataagcaggaatgaataaaagttttgaggaaaatactattttactcatgagactaagccttaaagttaatacaattttaggacaatagtcttcagctatgtttttctcacctatgtttgtaactccagtggaaaaatatctttgaagtccatggcaaagcttcatgctcagagaagaaataaagctagagatgacgtcttgttcactttcatactacaggctgtatgttgccagcacttactagctttccttgaattaaagtacatatactactactgttgctctccatttgattttctctttgtaatagatgaaaaagcctcacctcagccactgtactactgggctagtttcttaaagcaggggtccccagcccacagaccatggaccaatagtgtccatggcctgttagaaacaaagctgcacagcaggaggtgagcagcaggtgagtgagcaaagcttcatctgtatttactgccgctccctatcactcacattaccgcctgagtgccacctcctgtcagatcagtggcagcattagatactcataggaacacaaaccgtattgtgaattacacatgtgagggatctaggttgcacgcttcttatgagaatctaatgtctgatgatctgaggtggggctgcagccgtgatgctagagctggggagcggctgcaaataaagattaacattagcagagaggtgtgacggcacagagacaatagtaaatcaattgcttgtagactcatatcaaaaaccctgtcagtgagtggaaagtgacaagctgcatctgatggcaggctttagagtcgaaagtgagttgatgtacttcagttgtacagctgcttttggtgcctttaaaggtatgtttgagacaacttcaaatttccatacattctggattaaactttcgaagcagaatatcctgaaattgccacaaaagcactgaaaagcctgcttccatttccaacatgctatcttagtgaagcagggttttctacagtgatagcaaccaaagtgagattatggagtagactgtacataagcaacacacttcaggtgtcactgtctcccatcagccccagatgggaccgtctagttgcaggaaaccaagctgagagctcccactgattccacatagtgagtggaataatctacatcataataagttgtataatcatttcattatatattacagtataataataatagaaataatgtgcacaataaatgtcatgtgcttgaaccatccccaaaccttctcccatccctggtctgtggaaaaattgtcttccacaaaactggtccctggtgccaaaaaggttgggaaccactgtcttaaagaaacaatgctaaatacagacttgtcagatctctgcataatataagcatcaaaataattcatccagactagtggtattttaggatacttttcttttttttatactgagcttgtctgcattgattatattatctaaataactggcaaattttatacttcattttgtcaacaaaagcacatcttgagaatccaaaacatcttttatttctaaagctgaagaatcatcagtcatttaccaggtgactaagagcatggataagactcgttatgtcctctattagaactgtgggtgtccccttcatagatggtaacagtcacttgaaatgttttatacaattatgtattttaaataaatggtctttcattctgtggatgttagttatcatagaaatggattctgttcccacaaaacaatttggaaacgtgggctgggtggcgtggctcacacctgtaatcccagcactttgggaagccaaaaataactaccaaatatacaaaaactagccaggtgtgatggtgcatgctggtagtcgcagcttctcaggaggctgaggagggagaatcacttgaacccaggaggcagaggttgcagtaagccgagattacaccccgcactccagcctgggtgacagagggagatctgtctccaaaaccaaaaaaacaaaaacaaaaacaaaacagaaaaccaatgtggaaactcagattgggagctcagtcttgttaaataactgatggcatcattcaattctctagggatgaagagttgaggattttttctttttcctcttctccagaaaaacaaaaaagaaaaacaaagaaaacaaaagcaaaaatctagctgttgaccttgagaatatcttactattttacttttggagataaattttataggtgcaagaatgatttcaaacccacacttttcaacctgggaaaaatgttctaaatatgggacagggatggaaaatttggaaactccacagatctctctgaagctgtttatttcctttgtttcttctatgtaaacctttagggtgcaagttaaaaactacggccaggggctgaaactggctacagaagttctgcacattaccagtctattttctgacatctcctctcttcatgaaattaaattatccttctgggacctaaagactctagaacctgagacttctgcttaaatccatctcttaaacctaatatgataattattatcattatttttttagacggaatctcactctgtcacccagggtggagtgcagctcggctcactgcaacctccacctcctgggtccaagtaattgtcctgcctcagcctccaaagtagctgggattaccggcgtgcaccaccatgcctggctaatttttgtatttttagtagagatggggtttcaccatgttggccaggctgatctcgaactcctgacctcaagtgatccacccaccttcagcatcccaaagtgctgggattacaggtgtgagccaccatgcccagcctaatatgaaaattattttaggtaaaatagtaaaggatgtgattgtgacctattattaacgctatgcaggtatttaacacaatgcgtggcatatagtcattactcaataaatcatagcatattagcacttggtaatatcttctaggcatttgagaagttcatcttacctttttctacttttctgtaaaaatttgtttttcagagacaggtcttgctctgtcacccaggctggagtgcagcagcgtgaccatagctcatgtaacctggaactcctgagcccaagcgaccctcccacctcagcctctgtagtagctaggactgcaggtgcatgctatcacgcctggctttttttttttttttttttttaattggtagagataggatcttactatgttgtccacgctggtcttgaactcatttattccagtgatcttcccacttcagcctcccaaagtgctgggactacaagcgtgagccactgtaccaagcctagactatgttcctgtcactactttattctctgtctttagagaatgcctacatttcatttttttaaaaacaaaattttctggccaagcgcggtggctctcgcctgtaatcccagcactttaggttggcgaggcgggcagatcacgaggtcaggagatcgagaccatcctggctaacacggtgaaaccccatctctactaaaaatacaaaaaatgagccgggtgtggtggcgcgcggctgtagtcccagctactaggcaggctaagggaggagaatcgcttgaatccgggaggcagaggttgcagtgagccgagatcgcgccactgcactccagtctgggcgacagaatgagactctgtctgaaacaacaacaacaaacctcacaagattttctttaaattaccttgtccaaagtgagctgccttgtgcacggcttgaacacctgggtatcccaagctcctacagacgacctgtccaacgcgcacttcccagcgatcgtcacaaattgtaccccactggccgctgtggagtatctccaccctcccctcgtgagggccgctcccaccgaccagtcgaactttcgtaaatggagctgtaaagttaaaaaaaaaaaaaaaaaaaaaaaaaggcaagcaaggactaattatgtacatactgctttacagcactttttttttaaacacaaaaaaatgtttagcacattttccaaataacttcaactattggaataaatattaaactttctagcaccacctattggtaaagagtttaactgcaaatattgcagctttaacagctgttaagagcaaaatccaatctgtcttacatgtaagttatatatacgaggacacgtcacagattatattccaacgagtttgaattttgacagatacaagtttattgtcacttagattttttcataccattgaaaaattataactaaatggttcattattttcttgacatacaaacatacaaacttatcaacatacaatgcagagattttcaatactataggagggcgaggagcagatattttagaatatcataaacacaaaaataggtgatcaaacttcatatcttttcccaagggaaacaagggaactatagtgacaaccttcatttagaaatagcaaagactttccttgttgtgaggttcctggattctgtaacaaagatttttgtgtttttcctctttagaaaaaaatattaacgagataaaaaatcagacaattttgtttatttttagaagtgattcaaatagtaaactacaaagaaataaactttgtttataattataaaagtaattttgttctgtaatgtctaatcaaaatgaccatatgtacaataaacttttgtaaaatcttgatcatgctacagaaagatttacataaatatgaaatggctcttttctatttttaaaaaccaatatatatgcactttgacctagtgacagattaaataaaatagtgcaacaaatattataagagcaattcacttggcgtatgaaaaatctctcaacagcctgtattattctgctaagtatttgtttagaaaattatttggctaaagaacagaatgaaaggcagagatgaaaaattatttttaaaaatttagttaatattaaataaaaataatattttctaataatcataaaaactaataaatgtaattctacgtaaacaaaagatagcttttcaaatataagtttgaggaatgttatattataaaaaagatgtaattttcataacaaaaatatctctctaatgtgaaaatggagttttaaggaatgggtttttggagctcaattaattgaagaaatattcagtaacttctttttctccagtttgaattcattttgttagaacggtaatctaataacatttaaagttactagattactgtttcaacaaatgtttttaacttatgcttattactgttttaacagtaatttaataacatttaaagttattagattactgacaatttcctgtaatgaaattgagtgacctgagctatgcagaaacataaaaggtggcatgttactatatatataattataattattctcttgattcttccaaaatataattcagtgctaaatactgatttagtgtaagcatgcctgagtggataagtccttcttcacttaataagcataagttaaaaacactttaaaacatgaaaataatttgttattatagtatttcaactttcatttactagtaaaattcctgagtggcccaatcatttcctgtaattgcctaaagaaaacgagaaagaaaaatccaagaatggattgtgagaagcctttacatattagagacatgttttattaactagtgtgatatccaaatgtttatttttatacaagtcaaatatatccaaacataatatatttatcatgcatgcatgctatgaaaaatcaggcatactcaaacatttgattatatgagcatcgttgtcctgttgtccaaacaagtgaatgtaagcattctcactgcccattgtttacctcttactccttccaaaatgtcataaatgagccttgcttgtcctggagcagtggttctcaaagaataatatgcagcagaacaagctcccaacagctaattctgttggtccagggaccacactttgagaaccactaacctagatgattgcagtatatatttagaagaggagacatattatatcagaaacagatagtgctgctgatacaatcctttcatctcatttattgcaaagggaatggctgactgtaaatttctgccaaattccgtatgctcaagggatcctgagggggagtaggtacctctattcaaattctttttttttttttttttttttgagacggagtcttgctgtctcccaggctggagtgtagtggcgcgatctcggctcactgcaagctccacctcccgggttcaagccatcctcctgcctcagcctccggagtagctacgactacaggtgcctgccaccacgcccagctaattttttgtattttttagtacagacggggtttcaccgtgttagccaggatggtctggatttcctgacctcgtgatccgcccgactcggcctgccaaagtgctgggattacaggcataagccacggcacccggccctctattcaaattctttagggccaaatatgcttgggtatgctgatccatatctgtcacctgaaatatttttcagttataaataaactattgacaggtgaccacacattgctgatccttgaccatctctgaagtaatatagaggaaaggcgtctcaataggtcagtagactcatttgagagttggcttcacctactattcaactgctctgttttggtgatgtagaaaagttcattttgtcatcaaccttgatcataggattttctctgtaagactgaaggatcaaaacttctctgaaagtagctaattcactgtcacaaagatgtaaagaatgtctgtcgtttctttggcaacaagctaatatatttagtcagatagggctttttttttttccatttgggtatttttatcttgtatataaagatttcagaagacatgtatatgtgtgtgtgtgtgtgtgtgtctggatagctgtttcctctttatttgtgtagacattttctacattcaaatcaaataaacacagataagcatagactatgtgcctaaacgatttcgtgtattattattttttaattggtgaaaaaacagaaacagaaactaaagtaatttaaaccaaaaccaaaataataatgtattttaaggacactggatgtttcatagaacccaaggataagattatagttaggtatctgcaatagctgacccaagacccgaatctgcttaggagtctccaacttgtactcaagcttctttctgtaggttgctttattattctttttttgttgcaagctagatatctttgctctcctgttcacttgatagaacatgtctgttaacagctcctaagtttatattttacagtttctttcttgatgacagttactgtctctttctcagtgacagactgacagttctgacactcacctaacttgatattttacagcctatttcttagtgatagtttctaaaatatccagggaagttcttctatggcctagtttgggccaaatgcccacctgtggactggacaaacaggccgagtcacttgcatgaacatggcattcccacagtgagaatggggaggcatttccttgttgaaagagttttgagcagacaaaaaatcttaagtccattccataaaagatattttaataatcttggtgcatttatgcaaatatttgctgtttctttacagaaaaagtttgggaatccctggtagaattacaaacatagtagacgagaatgatagaggatttcctgggaatactcttgtcaagtgacttgtggaataaataaggtcatgcttaatctctgctcacctttccaacctaacccttgagaaattctccccacctgcactgctttgtctttttactttatatataactactcacattttccaaataagtctcattctcctttatttctggggctttggttcctgtctggaatgttccttcttcccttcccacttcccctctcatttctacactctcaatctccaaatttcgattggttactcaatagcactattacagatgctataccaaactgcagtaaacttgtttgttttccccagtagactgaaagaaacccgttatagtcatcttttcagcatctgacaagatgcaagttgtcactcagtagtcacttgaggaagagttatggcatgaatgagtaaataaatgaatggtaagcttctcttgatacatgaactgcattacccagtgagattaaattggcaaatgcttaaaatatcaaatcatagaagaaactgaatttaatatttcataagtcttcagagggaatagaatatagtttctatgagtagaaacagaaaaatcatgaaggaaagattgatttaactggcataaacataagtgtttttatggaaaaaaacccatatggctggctactgagagcctctccaaatacgagcttttggtgggaggctctgatcagagaagcctgagacattagaaaatctgatcttgtcagctcagtgagcagatctatctcttagaggcagactaatgttaaacagaatcttgggactaaatgtcaattcaatttacaatgagaaatgtaattgccttaaaaactggaatatttgaatctgcttgacaaggccactttctccccttgggaaatctgcatgggaaggcaaatcacagtgagtgaactcttagtttaattaatttattaatttacaaagagacttagcagtgagattttgcttctgggatggccaatgatctttcgttaacacatttttctttatatatgttaatacattcagtcaggtaaaatgatttgacatatctctgctgattcattgaatgttcattctatagtttaactttttaaaggcaatctcactattcttatgtcccatttctttacatctctatgacaatgagttagctagtttcagagaagtttcaatcctttctttaggaaagaactgggacataagaatagtacatacatatgtagtaaatgcacaaaaacatgaacggaaggaaacaaactccaggataaaggtttaccctggaaaggaagacaggtagacatactggtacttcaactctgctcataacattgtatttcttttaaaaatttttaaaagtttttctttagagataaggtgtccctgtgtctcccagattgaagtgctgtggtgcagtcatagctcactgcagcctcaaactcctgggctcaagtgatcctcctgccttggcctcccaaggtgatgtgattacaggtatgagccactgcacccagccaaaattatatctcttaaaaaacaaatacttgtaatcaagatggtaaatgtgaacatttcaaaggtccaagtggtacacatgactgtgtattagctatttattataaatattatttcttttctttatttttgaaatatattttatttaaagaaggaaacaacacattcactgcaatgttcacagagccatacctgaaccctgcacaaattatttaaagtgttccatatatgagtctacccttaaaagttagagaaaagatactacgaatctattcatcgctgttagaaagacaacattcaaacttgaaaagtcagggaacatgtaaggtcttctttgcatgtgtcaattaccactactcagtggaaagaaataatcgaacatagaaatgacttttgaggagcataacagttattatcctattgtttactcatagtcatgatttcctttttgtatcatttattggaattaggatttagggttaaatttattacaatggtagttatgatatttgagatgcaaacataatacagaaattaaaaaaaaatctggttgcagtttgacctgaaagttctcacaacatggcaaaattcctttaagaagataactgattctttatttaagataattaccttaatgagatacttagcaatgaaatgtgcaacccaaatatcagatacctgaagaaactgagttaaatttctctagaaaatttctctagaaaaataacataacatattgtgttactcctaaagccagggagacaagtatttgggacagagtcaagaggagatatttttgtattttttgaagagacgggatttcaccacgtagcctaggctggtctccaactcctgagctcaagcgatttgcttgctttggcctcccaaagtactgggattacagacatgagccactgcacccggccataggtataattttgcacagtttacttaatggttctaaatcctcatggggagaacaccagagtgatagattccttgtggggattaagtaaaggaggtatataaagtgcttttcagagtgtctggtacagagggttcattctacacattataggtattattgatactattatttcttaaaaattcaaatttctggcctaatgatggggaataggtgatgggagaaaaaaagtatcatatattaaatagcagtttctcaactactttgtgcttcagaatcccaaggagaacttttggaaatcacatgtatcaaggccacagcacaaactccctgaaatcagaatatctgtgtgtcatgtccaggcatctttatatgataaaagcctcacgagtcattctgatgttcaccatatcctgagcccaacttctagaacaatactagaatacatatgaccacttagagagttacaaatcattcgcattatggaagaattaaactaatacatcgccgcccaataagcaatcagcaagactatttctaaacatgattgaacaagatagtgagtttgatccactttttagtgccctggaccctgcattctgagatttttaaagcaaatcttgtcttatccaccatttggtaattatcttttcgggttaggcaatgagtatatcttatctctacacacaatagcttgtcaaggggaaagctcaggatcaaaagtagagacagagttattttgaaggaaaaaatgcggcattctttcttagccatggctagatgttaagataatgccacacaagagctgacttcacaatgaatataacatatctaaagagaaagagagagcgagactgagtccaaatgatttactttgaacacctggatcctgctatgcctgaagccatctgtgggaattgtaattcttaattatgtaaaccaatagactctattttgtgattaaagatgtttctgttactttccacttaacagttcttacaaatatctccatggtgattatttgtcaaagaatattagaagtgattgcccaggtcatcctgtttgtcattaatcccatcaccattggttattgtctgtttaaacagcattattctggtaatttttattatctcatgagacaatgtaaaagaacatcactgaaatgtaaatacacaatattggcagtaaacaaaagtgaaattgttctcataactataaaaacaccagaatgcatcaaatttacttatggtgcaatttaggccctctttaagaacaaagttacagaaacatagacaaagaaaactgaattcatcctgaaacagttccagccgtgtgctgcagagatcctgcccacagacagaggatcaattcttgataccttcctattatgtactgaattgtgtcgctccaatattcgtatgctgaagtccccaatgtgactatatttaaagatagaggccatatggaggtaattcaggttcaattaggtcataagggcagaatcctaacttgataggacaggtgccctatcggaagagataaagacaccaggagctcagtgctcacacagaaactgcctcatgaagtcacaatgagaagggggccgtctgcaagccaaagagaagcctcaggagaagccaatcctgcccccagcttgatcatgggcttttaatgtcaagaactctgaggaaataaatgtctataatttaagctactttatctgtggtattctgttctgacagcccaagcagactaatacgttttcttttttcacttatgttatgtttttacttgcaaacgagaaatagcatacttcagtgcatataaacttaaaaatacaagctgcttctttaatttataggtggagttaagctaccatacttgctatgttgtgatttgaacacactgaaaatctcttttccgaaaataatcactttgtccctaaaacacctactttaaaagctgatttttattcaaaaatgacataagtacttacgaaggacctattagatgttttaatacgttaataataataatatgtttgttagcttacactctgtgattgataaagcacatgtccttttggtgcagaaatagtatttctaggtgcaggtaatgtactgggtaacaggattaagtgagaatgcaacagggaagagttcgaggtggaagatgttttataataaaacataatcattttataggggaaataagttttgctgtaaatcatatgaagttttagtgaaaatactgtacacagaaactgaatatttgtatgcagttaaagaggtttacttgttctttgaactttctaggaaataaaaatgcagaattatataaaacgtcattaggaaatgggtcattttgctaaataattcacattagaattcctttatataggtccctaaaatacctgagggtccaatgttttactttggcatggattaagcaggatatgagtaagaagtagaaaatgaaaataactacagcatccgggaaaggattaagagtctgtaggctaagccataatgggggaatttcttggagactccatgtgaaacaagccaactgtgtcgttctaggaaatctcgtcttaagattcacctcaggttgggtgccgtggcttatgtctgtaaccccagcactttgggaggtcaaggcaggcagatcatttgagtttagcagttagagaccagcctgggcaagacagcaaaaccccgttccctacaaaaaattttaaaaaacagctgagtgtggtgacctgtgcctgtagttccagctacctgggaggctgaggtgggaagatcacttgaggacaggaggcagagattacagtgacccaagatcatgccactgcactccagcctgggtcacagaaagagactatcccctcaacacgccctaaaaaagatttacatcttaagggcaggacatttccagagacgatcggctgaagggggcaaataataggctgtgagcccatacaagtccagtgcttgaatttgagcaaaataaataatcttgtgtgagtatcaggctaaatttcttactgcagaataggaagcctggagttgtttcttcaaagggcaggaaaggtacttggtactcaggctatggaggaaagggaagtggagtgttgggcctctgcttcatctgcattcctgcacataattgcatgaatttccacttttgctgctgtgaaaaatggggctgatgtttttccttctaattggttctggtgagagtgaggctgtgagagtcagctgggatagggactaagcaggacaagtgctaactgctggatccataattgatttaaatctctatttcaaacgacacaacatacaggtatatcctgttttattggtcttcactttattgcacttcacagatcctgcatgttttacagattgaaaatttgtggtaattctgtgtcctgcaagtctgtcagtgtcatttttccaatagcatgtgctcgctttgtgtctttgtgtcacattttgcaaattctcacagcatttcaaacttttcctttgtttcaaatgctttcttctgcccccacttagatgagcactgtattttatctttaagtatattaacatggtgacaaattgatttatttcattttttaaaacttttatattaggttcaggcgtacctgtgaaggttggttatataggtaaattgcgtgtcgtggcaatttggtggacacagattattttgtcttcgaggtaataagcatagcagctgagagcttttcgatcctcaccctcctcccaccttccaccctcaagtagaccccactgtctgttgttcccttctttgtgtccgtatctactcaaagttcagtccccacttataggtgagaacatgaagtgtttggttttctgcttgtgtgtgtgtttgtaaggataatggcctccagttccaaccatattccttcaaagaacgtgactcattcttttgtatggctgcatggtattccacggtgtatatgtaccacattttctttatccagtctaccaatgatgggcatttaggttgattccatgtctttgctattgtgaatagtgctgtgatgaacatatgagagtatgtgtttttatggtagaacgatttgtattcttcgggtatatactcagtaatgggattgctgggtcaaatggtaattctgttttaagttctttgataaaccaccaaagtgctttccacaataactgaactaatttacatttccatgagcagacgataagcattctcttttctccacgaactcgtcaccacagcatctgtaattttttgactttttaataaacagccattctgacaggtgtgaggtggtatctcattgtgcttttggtttgcatttctctaatgattagtgatgttgaacatttttgcatatgcttgttggccacgtgtacgtcttcctttgaaaattgtctgttcatgtcctttgcctattttttgtcaggtttattttttgcttgttaagttccttacagattctggatattagacattttttgatacatagtttgcaaatattttctcccattctatgtatctgtttactctgttgatagttttttttttttttttttttttttgtggtgcagcagctctctaattaggacccatttgtcaatttttatttttgatgcaattgcttttggcatcttcatcgtgaaatctttaccaggtcctatgttcagaatggtatttcataggttatctttcagagtttttatagttttaggctttacttttaagtctttaatccatcttgagttgatttttgtatatggtgtaaggaaagagttcagtttcagtcttctgcatatggctaatcagttatcccagcaccatttattgaaaagggagtccttttcctattgcttgtttttatcggctttgtcaaagatcaaatagttgtagatggttggcaatgtttctgggttctctattctgttccattggtgtatgtgtctgtttttgtactagtaccatgctgtttttgttctgtacccctgtagtatagtttgaagtcaggtaccatgatatctccagctttgttctttttcttaaaattggcttggctctttgggctcttctttggttccatatacactttacaatagggttttttttttttctaattacgtgaagaatgtcattggtagtttgagaggaatagcattgaatgtataaattgctttgggtggtgtggccattttaatgataccgattcttcctatccatgagcttggaatgtttttctatttttttgtgtcatctaggatttctttgagcagtggtttgtagttctccttgtagaagtccttcactcccctttttagctgtattcctaggaattttattctttttgtggcaattgtgaatggggttgcattcctgatttggctctcagcttgactgttattggtgtacagaaatgctagtgatttttgtacactgattttgtatcctgaaactttgttgaagttgtttatcagctgaaagagcttttgggtcaagactatggggttttctagatatagaatcatgttgtctgcaaacagatagtttgactttttctctttctattttgatactgtgtatttctttttttgttttgttttgtttttttgagacagagtctcaccctgtcacccaggctggagtgcagtggcatgatcttggctcactgcaacccctgcctcccaggttcaagtgattctcctgcctcagccccccaagtagctgggactacaggcacccaccaccacactggctgatttttgtatttttagtacagacgggttttgccatttggccaggctggtctggaactccttacctcaggtgatcttcccactgcagcctcccaaagtagatgccctatatttccttatcttgcctgattgctctggccaggacttccaataccatgctgaacaggagtagtggagagggcatcattatcttgtgctggttttcaagcagaatgtttccaggttttgcccatttaatatgatgtcgctgtgggtttttcaaagatggctcttattattttgagatatgttccttcaacacctactgcattgagagtttttaacatgaagaggtgttgaattttatcagaagcgtttgctgtatctattgagatcatcatgtagtttttgttgttagttttatgaggtgaatcacatttattgatttgcaaacttttccattattagtaaaatatggggagattaaaacagtttgtggaaaaaagcaattaaaaggtaaaaatcacaaaatataaattttacttctcaacataagctccatcaagttcaagacacttttataggtgatgatactagccatttagtccattcctaaagacctgaggatcttaagaatttaactatatcaatgttgtaatcttctcattattgaaagaagaaaaattggtgtcctttaaaaatattttgagagtgggaagctaaaagaagtcagaaggagccaaatgaagattgtaaggtagatgcccaatgatttcccattgaaactctcccaaaaattgtcctagtttgatgagagaaatgagcaagagcattgtcatgatggagactccctggagaagctttcctgggagtttactgttaaaactttggataactttctcaaaatactctcatagtaagcctaggttaccattctttggccctccaggaagtcaacaagaaaaatcacttgagcatcctcaaaaactgttgtgagaacctttgttcttgactggtctgcttttgctttgactgtaacacttctacctcttggtagccattgctttgattatgcattgtcttcaggattatactgggaaatccatgttttatcttctcctataattcttcaaataaatgcctcaggatattgaccccacttatttaagatttccactgaaagctctgctgttgtctgcagctgatctggacacaatagttttggcacccatctagaaaaaactttactcaaccttaatttctaagtcacagttgtgcaagccaaaccagttgagatgtctgtggtgttggctgttgttctgctgtctcagttcttttcaattaaggcacaaacaagatgtatttttttcctcacaaattgacgtggatagtcagctgctgcagggttcatcttcaatattttcttatccctttgtaaaactgagttctctttttgtcaactgctgattcctttgggacattgtgcctataaacttttcataaagtatcggtgatttcaccattcttccaaacaagtttcatcataaatttcatgtgtgttcttggttccattttagcaatatttatgtggctctgataggggctctttttaaatagataccttattgttcttagtgcatcaaattagattctattcagacatgttataataagctagcttgttttagtgcagaatttttgaaatccatgtatagtgttttcctaatacatattttccatgattttttgaagaccccttgcatttgttatggcaatcagtgacctttgagattactactgtgattagtttggggaaccacaaaccatgcccgtaaaagatggcaaacttagttgatatatgttgtgtgtattctgactgctccaccaactggctgttcccccttctgtctctcttcctctcctcaggcatccctattccctgagacacagcaatattgaaattaaacaaattagtaaccttaacaacggcctctaagtgttccattgaaaggaagagtggcacatctctcatttaaatcaaaagctacacatgataaaccttagtgagaaaggcgggttgaaagtcaagacaggctgaaagtatgaaatttacctaagttgtaaatgtgagaaaaagttcttgaaagcaattaaaagtgccactccagtgaacacaaaaataataagaaaacaaaccaccttattgccgatataaagttttagttagtggccttcatatatgatcaaaataaccatgacactcacttaagacaaatccaagtccagagcaaggctctacctctcttcaattctatggaggctgagaaaggtgaggaaactgcaggagaaaagttggaagctagcagaggttggttcataaggtttaaggaaagaagccatctccataacataaaagtacaagatgatttagcaagtgtggatatagaagcttcagaaaattgtccagaagatctagttaggataattgatgaaggttactacactacacaacagattttcaatgtagatgaaacagcttctgttgaaaaagatgccatctataactttcatacttagagaggagttcatgcttgacttcaaagctttgaagtataggctaattcccttgttaggggctaatgcagccagtgactttaagttgaaggaaatgctcatttgctattctgaaaattctagggcccttatgagttatgctaaatgtcctctccctgtgctctagaaataggacaatgaggcctgggtgacagcacgtctgttgacagcatggtttactgaatattttaatcttactgttgagacttattgctgagaaaaaaaatccttttaaaatattactgctcattgagagtgcacctggtcacccaagagctctgatggagatggacagaaagactggtgttgttttcatgcctgctaacacaatatccattgtgtagcccatggatccaggattaatttttactttcaagtcttattacttaagaaatacatcttgtaaggctgtaactgacacagagagtgattcctctgatgtgtctgagcaaagtaaattgaaaactttttggaaaggtttcacaatcctatatggcattaaaataatttataattcatgggagaaggtcaaagtattgaggttaactgaaatttggaagaagttgattccaaccctcatgaatgactgtgaggggttcaagactttaatggagaaagtcactacagatgtggtataaataataagagaagtggagaactagaattagaagtggagcctgaggatgtggctgaattgctgcaatcgataaaacttgaatggattaggggttgcttcttatggatgagcaaagaaagggtttttttgagatacaacctactcctgaagggaagatgctgtgaacattgttgagacgacaacaaaggatttagagtatcatatagatttagttgacaaagcagcagcagagtatgagaagactgattttaattttgaaagaagttctaaagtgggtcaatgctatcaaatagcatccattgcatgcagcagagaaatctctcatgaggagaagactccatcaacgtggcatatttcattgttgtcttaagaaattgccacagccacctcaatcttcagcaaccatcacgctgattagtaagcagccatcaacacggaggcaagaccctccaccagaaaaagataacaacttccggaaggttcaaatgattgttagcattttttagcaataaagtattttaaaaattaaagaacacttaatagactccagtgtagtgtaaatataactattatatgcactgggaaaccaaaaaatttgtctggcatgtttcattgtgataattgctttttttttgccttggtctggaactgaaaccacaatatgtccacagtatgcctgtattagctatacactctattaaggaacacatctattgtgttaatggaatgctgcattttttttgagaaggagtattgctctgtctccaggcgggagtgcagtggcatgatctcagctcactgcaacctctgcctcctgggttcaagcgattctcctgcctcagcctctcaagtatttgggactacaggcatgcacaaccacacccagctaaattttgtattttcggtagagacagggtttcaccatgttggccaggatggtctcaatctcttgaccttgtgatccacccaccttggcctcccaaagcgctgggattacacgtgtgagccaccgctaatttgtgaacccacagaaagctctaaacaccatgtaactgtcaaggatgagcagcatttacctaagttacctggaaccatccctactcaggtacactcagttctgctaactcataactagtgctactaagaaagtacattatggagttaaaaaaaaagacacaataaaaaaagagagacattggagcagccaaataatagtgaaaaatgttaaggctgagcccgttagcaaaataaagatagaatattaacaggtagctcttccccaggtgcacataagtagctctcattagtgataatggaagctttgtgagcattctaggaagactatgtttctgagtaatatccttaggagggagactagaggcaatagctggagtagttatgaaggtggaaacacaaacaaataaagaataactgagaatgcttatttggaatttgatctgccgtaagaatttttatctctttagctcttcaaattactaggcccattctagaaaaccaaactgctcattacaaatttcttccttttctgcctttctctctctctatctatctctttctctctttccctctctttctctttgcataccctccacatgacatatctgtgatatatataaaaatacataatactagtgtgggaatattgaatggagtcataaggactttggagatttaaagacctggctttgagtttctgttcttccacttattagcagtaagccacagtttataattctagaaattgggataatagtccttcacccaaatgctcttctgaggattaatgtataatgcaccaaaaaccctgttgggttgggtgtagtggctcacacctgtaatcccaagattttgggaggttgaggcaggaggatcgcttgaggccaagagtttgcaccagccttggcaatatagtgagatcccatttttatttttatttttttaaatagccaagcatggtggtgtgtgcctaaagtcctagctactcaggaggctgaggtgggaggatcatttaagcccaggagcttaaagctgcagggagctatggtcgtgccactgtagtccaacctgtgcaacagagcaagactctgtctcttaaaaaaagataaaggaaaaaaaaaaaaagcccttgcctcacaggctttactttgatcaacaatgctttggaaaaagactagtattcatttaagattgagctgagtccttagtaaaaatcaaatgaaaaaacaaatggatttttcctatcgttgtttgagttttagataggatactcaaaattcacatcctagttgtagtctcattgcacttgagcaaagaatgatgagaaatactaccaaaccacatattggtaattgagatatttaggacagagcctcacacaagtgttgtattgtatggtaggaatcatttcgtgtgactgaaacatcactcttccgcgttaaggtgagaacacaacagacgattcactatgactagcgttagagcttagtgaaggcttcttttctcttcattatgcatttttaaagttgataaaatttgtgccatttgtgccaataatttgaacagggcattcagcatccattttttgtctaaagagagaagactttcttccctaatttgaaaagtttggattagtttttcacactgaaaaatctatatttagtctaggatgtcagatgactttttaactgaatccctggaattgtctcccagcatctctgggaccgaggccatcgtgtggctgatgtagaccaaggtctgctgaagaaagctgctcatactctacctgacttgcagtgcagaatgggacaggaggtctcacaaaattaaaccaaggaaaaggagttacaacttatctctagatgtttgtgtaaactggctattcaatgttgctagcctgctaatagtcaggagtatctgaacaagtggctaattcttctctcccttttatttctggagattttaatgtcatgtaggcataaaaccagagtaccattgacaactctaacttgtttcaacctttcttggaattttctcatcagcattgtcttgggcccatgctttgttcttcagagactggactcttgttttattagcctgacattttgttttgacctctgttgacaccttctgccctccggcgtgcactctgtttagtagcttcttttatttataactaatgctcttctgctcgactcagacaaactcattgatttgcaatctggtcacacttgcattgctctatctaatataaaatcttttctttttctcgagcatctctctttttgccatgacatttattcagcttcttgcattttcattttgctttcactcctattctgattacagattaaaaatgtctgcattataccagcggggaaaagctattccagttcagagagatcactgcgaagcataccttacatctttaaaggactttatgatttcacagagcatcttcacacacacaatatcttacttgatcctcacaacaaccctgtgaggtaggtgttaacatgttcattatacaagagtgggaataaaaatgctgagatacacagaggcataccatctagagttctactagaatcttaatagtatgaatcttgggtctgtgtgttaaaacgtaaaggaaagaagagttgtgaaaatgtagtctgttgatcagtagagagaaaccaaaaatataacatgtaatcccataagagatttttagaacaaaagaatattggtattctttttcatgatcaaaatatttttgtttgaaatgaccaggtaatacatgaaaagttttatttttggtttaaatgggttggataaattgcccaagctcgactacacttcaaaacttaaaaaaaaaaaaaaaaaaaaaaaaaaaatatatatatatatatatatatatatatatatatatatatatatatatatgctgtaatttggaaaataagaagatgagaaggtaaaataagaatcaatttttaaaaaatattctaaggaattaaaatttttttatctcctctgcatacctatccagccctgttcctcccccagtatagcttagatgtattgtaattgcttgttcatttgtctacatctcttagggacaattagctctgtaaaaccagagacaattatctcttattagctgttatgtccagctcatggaggtacataatggacatgtgaattaatgattgaatgaatggattttcttctatgacatccctatctctggttgagaataatgtttgaatataaagaactctcatattatcaatactcatgacagttctcctagaacccaataaattaaattgtgttctagactctaggtgaatgcgtgtagtccagcctgtgcaatagaacaaggctctgtctcttaaaacaagaaaaagaaaaaaaaaaagcccttgactcagtctttactttgatcaaaaatgctttggaaagagaccagtattcattgaagattgagctgattcctcagtaaaaatcaaatgaaaaacaaatggatttttcctatcattgtatgagttttagatgggatacttaaaatttacaccctagttgtagtctcattgcgcatgagcaaagcatggcgagaaatactaccaaaccacatattggtaattgagatatttaggacagagcctcacacaagtgttatattgtatggtaggaatcgctttgcttgactgaaacatcactcttccaagttagggtgagaacacagcagttctcctagaacccaataaattaaattgggttcaagactctaggtcaatgggtggcagagaactgaggactggttggagcagccctccagtccgtgcatgagaggtgtccaggctgggggtgataggggagagaggtgatggtggagtaattggagtaagaagaggtatgagcatgggagcagaggcccaaacagcaccagggaccaggagagaaggccatgtggaagtcaggtacaacacgggaaccaaagtcatttggaggagtcacaaaaggatcttggaagtcagttgtgcagatgacttgtccagaggtgaagggccttttaatgagatggtagcagaggatgtcccgcccaacccacctgatcttaagagggccctgccctaatatgatcagtgagttgtactggtcctgacacatatataaaggaggaaattaattatttttaacatattttcagaaagccttacaaaattttaaagatgcatatgaaaacattcaatataaattttcacataccaccattaactacagatgtggggaatcaggcactttcatacagaataaattggtacaagcttttagcagccatttacaataattcatcaaatggtaaaatgtatgtaacctttgaaccattgattctacttctagcaaattccctattaaaaagtattcccacaagattacatgtgagagtgttgaatgtagcattgtttattaaagtctgaccaaagcaaacaaaaatcatttagtgttcaggactagaggagtgaatggctatattatggtgattatggtgtagctgaataatagaataatgtgtagccattgagagaaaagaggtagtgacatatataatgatatggacagatgactgacatattaacataagcgaaaagcagaatataccacattagatgtttatgtatatcattctttgtttttaaagcattatgcagttgttatatactctgcatgaggagggagggcatggtggagaatgcagaggctgtatacaaacatctctcttactccttcctcaaagaaagcatgtgcataaactccaaaatagccatgaaaatactgtaactgaaaacatttctgaacatatctgaagaaaatgttcaaagcatttgataaccttaggtaatggaagacagtggggtgctgtttgcagtgtaaaaataaaaaaaaaatagtttcttatttgcaaaacttgactaaagtcaatgttaagaagctcagagaaagcctcaggaaaaggagataaaaacaaaagataaaataaaggcagagataaagataacataaggataagaaggagaactttttaagaggaactcagctgaaagtaaatggagtgaaaaggagaaagaaagaagtaagtcgagtaaaaagtacacagcaggtgggccaggcttggtggctcatgcctgtaatcccagcactttgggaggctgaggtgggcagatcatgaggtcaggggatcgagaccagcctggtcaaaatggtgaaaccccgtatctactaaataacaaaaattagctgggtgtggtggcatgtgcctgtaatcccagctactcaggaggctgaggtgggagaagaatcatttcaacccgggaggtggaggttgcagtgagccgagatggtgccactgcactccatcctggcgacagagcgagactccatctcaaaacaaacaaacaaacaaacaaaaaaacaaaaaagtatacagcattcaaaagtgaccacattaaagaacgaatggatagaatggagaaaagacagacagattaatgtttctattgttttaatataacagtaatactcattaagtaacactaaagtactccgaagacacacaatactctgttgtactttgaaagcatcatgattacactaatgactactctaatggctggtattcacaaccatgccctactttgtctaaatatgtcatacctacacaatattaggttaaaataattaggttttgtagggcagataaattgctactgtatatttctagataatgattacaaataaaaactgccagattttggtacataaaaggatttgccattatctgcctaaaacagacccctgatgattaaatatgatcaccctgtttgtgttacctatcccatggacacacagacacacacacacatcacatgtagtttctactgggaatacagagggagggaggagccttctgattctgagaagttaagtggggattccacactcctcttcataatcctttcattatatcagtatacattcagcctagacacaacaattgacttacagcatggcaaatagaagacatctcatctaatatttagtatttaaggtccaattaacaggttgtgtatattgcaacatgaggtcggcagtagattgacaaatattcttgttgtgaaatctattctgttgtaggtttaaaggtttagaacatggaataccacatttcaagtttttagaaaaataaacgaagagccccagacatcagatagttaatttttcagggttcttaaactgtccaaattcttatatttaaggtttcatttagtaaggaaggaggttgtaattgtttctatgcataagcttgattttcccttagtggatagaaattgacttgaaaattgaacaattttctttgtggaatttttagaaaatagtattcatcacaaaaacaaaagacaaatggataatgagattgaaagagttgtataatataatctatttgttttaccccaattagcatgcttatttgtagaaaattatgtttggcttccatagagtctgtatggatctgtgctgaagttgcgaacatttgcctcaagcccagatctctagtatcacagacttacttattacaagaattcacacagaaaacaaaatactatatacttacttaatgtgtttccactccccttttcccctttctggccttttggtccagaatttccttgagaaaagaagaaaaatatttgtttttaatcagggcaattcacaatgtttgctttaactggagacagatcatcacaaggtaattaaaatataatagaatggacagatattgaaatgtataataacattgtataatgttaacaataataatagttattacttaggaagctccattctgaactcaatattgtgatatttcaaattatttacaaggccctaaatgccccattttcctaaatcaagcaaagctgaagaataaggagtttgttttgtacttatttatcctccttttctcctcttcctttgactgggtcttactcacacccccaggaagtccagtgccttccatgagctcccacatcccgttcttatattcacattacatttatggttttcatttctttagagtgtaccatccccaaaaactgggctgccaatgactttctgggagtgttgagattcttactcatggggaaggtaggaagatccttggagcgttcacatctccaggatgatcacctttggttttgagaaacctcacccatttatacaggggtgtggtacaaatatttcatatgagggtcagggcttcaaatggatgcagaaacattgctagatctttttttttgccaacggattgctacttcacccactgtcccatttttaaaggggtgtgcaggagatctttctttagtaccaagaaatctcttaagattggtgctgttcctgcttattgagttttttttccaacagccatgagatacaatcagatcttcaagtaattactaccttgacataaatctagaactgatcctagtgctctctgtctcaaagtcaaaacctttgttaatgtttttgattccctccagcaaaactgagaaccttcaaccttttcatcctagagctcagaggatgtagtttaacaaccatagacttcaaaataataatagtaataatttagaaacccctgtgttgagttattttgctctgctacttactgggtatgtgacttgggacaagtctttaaatctttctgagctaaagtttattcttctataaaataaaaaaataacgcttttcattgtagagttgcctgttcattaagcactttgcccataaaagatacacataaaagatctagttcttcttattcctattcttcacctcctaaagcttagctggaatcttctctttgtgattttattctcagagaatgagagaaaaactttttcatcgcagttcattttatatggtacaattatatataattttagtgtttatatttatttttgatttctctagtttacattgtcttcatctgtgctttattttgaacatgtgtcattatgtatttcttagagaagattttggatcctaatttaccagctaaaaaaatacatatatataatgtaacatatacaatcagtagcatgagacttgaggcacttaaagagtaaacattattcccaattgaaattgtattttgaagatttaatgaaatgccaaccattttatatcaggtcataatatcaaatttctaattctctaattgctttgcataatgtgattatactttatatcattaaattcatttcttaattgtaattgagttgtttcaggtactgctaaattggcaaaaattgttgctaccacaaagcacccaaaacctttcctatattttgagagcatgctttaataaaatatagtgccaaattttcagattgtccaagaggaaaaagctctaagaaattgttaaaaattagggaagggaggagttaaaacaaagttctaactcttttcataaaagagaacataataagcaagcttaatttcattatttcaacattaacttcacaatgagaaaagagaaagaaactatgcattgttcttagaagtcttttcacacagcaacttgtcttagatatttcagaatagacatgcttaagccagagacatgcttgacccacgaaaggtccttgtagctctcagattctatgataaataaaaaattagtttcatgtttttattttgcctttgttcttataccactgtgacttttccttttaaagatggtaaaataaaatgccttatctccttataaaaaaacaaacaaatgttttgtatcattttaacatgattcagagatttgcttaccgatgatacttgaaaatcttttctcacacttgaaaacagcaaaaatatcctttctaatggagaggaatgtagtggtccttcagaatgatacctttggttaaaaatgaatgcaagggcttggtccaaacctagagttaactatctcctatcctatgtattactctttaataaaaagtaacttatatttctaaaagccattcaaaagtaagaaccaggtcatatgtaggaggatattctaacttgaaaggatgtaagagggggtgtcttcaataacatcatcatgatttcaagcattttttgtgagcctcttatatgagccggatactaggttagacatttctgcttacatgccttaattacactaaccaaatttctgcagctgtaggccgcctttccatcccccgtttctttcaagctactttcaaatgtgatcatcctctctcctaagccttgtgcttcttcctggtccctgaattcctcaccttataaccactcattaaccttacactatcttttttgctttgctttcctctgtcttcagccactcctcctctattttatctttccataagcatttaagtggtactcagatccttccttcaaagaaaaaaaaaaccatatgaaacaaacaaaactaacaaaaaatgcatctcttcctcctcctctgcatagtgaggcagcttgagagttgagtctaccacatctccaacccttatcaaccattcccttctccgcataccctaatctggttatcaccccaccccacagaatctgctctgaacaatggcaacatccccacagcagcaggtgcaaagggctttttgtagacttcaccttacttgaccacctttgaaactctgtgtttgccttttttcatgctctgttctctgggttttcttcttcagttgggctacttctcttccatttgctactttgttcatctcagcctgtacttctggaactacttaaagctttatgctatgccccttctctttgtacctttccactctctacccataaaatattattaaaatcagtggttctgaataatatttatataatcatagataaactttgtcttttaatctctggcctctactcgaaacttcagactcatgtgttcaaccgtctgtagatagctccatgaatcacagagagaaaatgttcagtaaacgtgttgaattaataaatgaactacatatggtgtaatattttagataatcctgaaaatgaccataacttaccctgagggaaacaataagtctttgaatggacttcaagaggcaaaacagacagaagtacgttatttgcatgctgaaagttctactatgttgaacaaggtagaacagaaccttctacggattttgaagacgggcaaggtttcacatcaattaaatcctccaaactttctgaagtaaatatatcaggtcttataaatggactactctatagatctgctatgcatggagaaagtgtgaagtcttctctttctcttctcatgtttgtgtatcttttcagttgtagactgtcttattcacccttcatttccctgtttctagcactgtacccttacgagcagtgtgtacttaatccatgtagaaggaaagggcaaggtgagaagaaaaggagtgtgggagggagaatagaagaaaatagatggaggatgttctttttgaactttttgcttcagaatctgataatgtttttgatatcattcacatagtccaggctgtgaaaaaattacaactcaagcaatgtaaagtatcaaagagtgtttatatcacaaattggggtcttagctctgaaatatattactttatctatcacggacctgtttttacttatttcatatttgacaattatcggacttatttctaattttagcaccttcttcagactcttgtagaggagagactgtactgttccttcttttagtctgcagtacaactagaacagcacctggcactgctgctgacatctctaccagattggtgtcttttaataagaagtgatgtcctaaggatatgttttgtcaagggacttattacctctgccgttgtttttctttgtgcgtgattactctttctgcactgtttttttccacctaaacataatggttttcaaaatgtggtccctggaccaatagcatcaccgtcacctggacattggtgaggatgcaagcccaatcccagacctactgcatcagaaactctggggtggagtcctgtaagctgttttaacacatcctcctggtgattccaacacctacaatagttttagaaatacaaacctaaagaaattctaggcctcttttagtccagcgctaacaaacactactttctatctaacacattttcttacagtatggaattaatcactccttactctctacttccatacagcaatttgtccaacctcaccaaggttgtttacttaccacatggcattatagctaattgcttatgcattttttttctgtatccagctccttaagaaaagcagctgtgctgtatttatctccagcacacagtgacccctcatcaagttgtgtgaactgggtgaatgaatgaaataatactctccaaagctaaacataggtttaccatttgatccaacaatcacactcttaggtaaactcctgtccacagaaaagccagcacattaatgtttatagctgctttacgtagaatttctaaaacttttttttttgagtcagggtctcactgttacccaggctggagtgcagtggcatgatcttggttcattgcaacctctgcctcctgggttcaagtgatcctcccacctcagcctcctgaataggatgccaccatgcctggctaatttttgtatcttttggtagagacacggtttcaccaggttggccaggctggtcttgaactgatgacctcaagtgatccgcccacctcagtgatctgcctgccttggcctccaaaagtgctacgattacaggtgtgagccaccacgcccagcctaaaactttgaagcaaccaaagcgtccttcagtagttgaatggataaacaaattgtggtaaatccataaaatggaatactattgagtaataaaaagaaatgagcaatcagaccatggaaagatatagagaaaccttacattcatattgctaagtgaaagaagccagtctgacaaggccacatactgtctgactccaactatatgacattctggaaaaggcaaaactatggagtcagtaaaaagatcagcagctgccaagagattgtggtggggaggaatagagttggtggagcacaggggacctttagggcagtgaaactattctgtctaatactgtaatgatggatacatgacattatacatctgctgaaacacataaaatgtacaacagaaagagtggccactaatgtacattatagattttgggtaataatatgtcagtgttggtttattaatggttacatatataccacactaatgcaagatgttaatagtagaggagaccatgtgtgcatgggtggtttatgggaactctctatgctttctgtgcagtttttctataaatgtaaaactgttctaaaaataaaatgtagtttaaaaatacctcaatgatagggaccctattccttttttttctttttcttatttttttagagacagggcctcactatgttgctcaggctcgtctcaaactcctgagctaagcaatcctcccacctcagcgtctcaaatagctgggactacaggtactcacctctgcacttggcccgactctattctcttgatgataattcactttgaaatgaggagacagtaagcctagctctttctaagattgctgttcaaagtttgcaatttaagcttaggctactggcagagctgatggaaataatatcatcatgtgtgtacatttcaaaatgctgagcaaccttgattcttaagcactagtagataatggcagacaatttattttgcagaggataggatttcagacttctctgtattttgctaacagtaacttcacaaagtctggccagttgtggttaaacgggtatttacactttgcttctttttttttctttgccagtctttcaactctctttgttcaaagacggatatcattgttagtgatgatttatgattgtgaggagtttataactcctgtgtgtttttttaaacgattttcctttgggatatagagactttcctcgggtgaacagaagtcagtttcaaaaatctgatttcagaaatcatttctagaccacaaaataactgcatgtgaatactagtattcacacaatgaccactttttatcatccaagaatttaaaaatatgtatactacatatataacattatgtgtgtgtgtatgtgtgtgtgtgtatatatatatatatatatatatatatatataaaattatctggtgtttcttctacatattctataaagaaaatacacattattgtaatacctggccttccggcatatcctgggagtcctcgacttccaggaaagccaattgctccccgatcacctttaagacccggaggacctacattattaacgaagaaaaaaagaaggtaataattcattttcatacagacttgagagtataatgaaaacatctagttttataagtgaatatgaaattagagaatcttcaaatgaaggaataatatctttcctaaaatttaatgtttgacattgaaaaacaatagaagcgataaatataaaccttagtacattcagcacattgtagctattcaataaataacatattgttggtagaaataaaagcacattaggaaaaatagatcttggagttttaaccaaaagacttatgtagtcaaccagtaatcatcaaatggcaggatcttgctgtagctgaaataataactttaaaatgcataagctgaaaattgaattcttaagatttgccttagaaaaaaatgcaactcaagcaatgtaaagtatcaacgagtgttttataaaataaattggtgtcttggctctgaaatatattactttatctatcatggacctgttcttacatatttcattgtaatcccagggtaaataaacataaacataaacacacacacacacacacacacacacacacacacatgcgatacacagatttacttatgagtatgtactatatacttacacaaatccagggtttcatatgcttaaatgaaaactgaaaatggctattttttttacccaatattactatggtgatcataacaactgtatataaaagaaaatgttatattccagtgaaataaaatattttatcctagagttcagtagttcttgataaactattgtaacagtttaggcatcttattttgtcattatcaattcagagagaactcgttcacccagtctcacttgatcccatggcagagaatgccatgttgcctgctttagacaggagcatcttggggccataagagcatcagagaagcccctccaatgctgacttctcaagtacctcacagtgatgctcagaacacagctgttcaactaaaaatcaaggatgttcaactacaaatcaagtacattttcaatgaatgaacaaataactctgtaaatgaagcatatgagatactttcatagaaatcaggcagtcatagacctctgttcttggagatggttaagcagactctatatggcctatggagttatgtgacttgtttgtttaatgatggttcaaaatgtagtccccaaaatgtaagcacagctgttgaactttattccataagatcagataccctgaggctttcaggaggcaattaactaattttctacaataatctgtggcaatgggaaagggtctggcacctgcttctaactcatggacaatataagtacagttacatggaatctcagccatgggatgttcaaagagacgttagacatcatcaagtcagaatccatcattttagagacagttccatgagaccagagtgatcaaatcacttacataaagctggtctgataattattcacatgtcctaggtgtcctgctccattcaggctccttcctgcaaagtagcagactggttaagggcatggactctgcactcatgcccattggggttcaaataccagctttgccacttaccagttgctgattgacctcaagcaagtcatttaactttactgtgcattgcacctgtaaaatgggtgtattatttgtttctgcatcatcaggctgatgtgatagttaaaagagctcatacacgtaaaacacttagaaaagtgcctggcatgtaatgactactttgtaaatgttagcttttcttgttctcctccccctcttcctcatcctcctcctcagtaatacaatcattatttttaccagcctgttgtaaaggcttctaaatttagttttattaaatgatacgtacacagttagcagtgacattttttgattcactggcacaatttgttacttccagaaaaaacccactttcaatactcaggtgtagagcgacagcctgcagccaggcaacattccttactcaggtgtatatttaaggatcctgtccttgctgaagctttagggaggggccttcttggggccatagcctatgggaaggggcgggccagggtaaagatatacgtggatataaacattaataaaatatggttcctctcttccaatatctatgggtaagatgagctttattttctcttctggaagcacgattcctatggtggaaaattcagactacgtaaggaagtaaatagtactggttgatgatgaaaagtttgcagccagagaagccttcagttctctcgagggcatctcatgtaggtagccccacccatgcctacaggtcaaactaccttgttattgatcacattgggcataaacagcttcttagatggcccacacaaagtttcctttagaaaagaaagttgcttctccttcaaaacattgttgtcatgggtaaaatcagccccttaaaagaaactcacatgagataaaaaatccttgatcatgacatttgcctcccttatattactacttatcatcctggaagcgctgtgaattcagagattctgtatctgtttacacatactctatagggtattgtagaacaccaggcctggagaaagtgctcagcacatagtttttgagtgaaaagtgataggtcattctccctagcatgctttcaaggaaatagccctctaaaataaatttgttattatttggggaataaagcatatttaaacataatatccaccctagtatatgaataataattctactatatttaatgtattagttatttgaggctactaggacaaccacttaggttttgcagatattcgcatcatgattgtgagtctaggtgagtttgacttggtcaagctgagtttagtaggctcaaatggatgtagagatggggaagcaataaacctgctcagattagaaagcagaattagtatgattgtccatcatatactctttgcttcctgatttcggcatcaaatataaggcaattagacaatctggtggagaaacgaacagaatgcagcaagacatccagaaataattcattaggaaagatgcctggtattttgaatacttttcttgtagtgcaccaaacaaaatggtaacctgataacctagaagagtcattgattaccccaggaactcgacctgtcttttatgaggaactgggtaatgcctatttgtgtaaatgagcagtaccaaaagcaacaaattatgacatcactttttaccctgtaaatttaaaccatgacaaatcgttaatttacaataaaaaaaaaacaaaatcaaagattctttgcaatggtgtctatttataacattaacacaagctgaaatttataaatccttctatttcatacattcacagttcagaaacagctgcagaagattctcccaagatgaagcactgtatggcaagatgtagcccagactgaatttttatggttgagttataaagctctgacaattgcagcctgtatggagggggtgatagacccttgacaatggtagttctggcagcagatttaatactggttatttcctctgcttatgacattaatgcagcattgttaatatctgattagcattagtcaagtagaaagactttcctgaataaaaattctttcctggcaaggcattcaaaagcacatcaatactaataccacctgacttggcatattatatatatgggtaggattgctattttatatatataaaacatgtgtacctggatgtatatcatctatcttcacatataatatgccatatatatttatatacatatatatacatatatgtgcttaggcaggtatcaagttcatgcttctcattttcaaaaatttttctgatgtgaccagggctagtcaatacactgatcagaaagaagaaccttttatataatcaaaagacagaaaaataagatgaagtacatggtatttagacatgttttggtaacacaaaccattctacttataattagaccttgcagtatacttcctaccatcaaacggcatgcaggatatttgatttcaagccaaggctaacatgacaatcatgttattatcttttttattttttcaagcaaagaaagttcatgttctctcttctgtgtcttctttcaaaatatttctttcaagattacaacttagaggaaaataatttgaaacagttttgctcttagtaaagcacagagagtgactgtcagcaaggtaagtgtcatccatattttagccaatatttacattcagatttcattagtttaaacagatatattccaaatactatataagaaatatagtccaatttgcttgtgattcataactcactactagtgtgagtttttatgtcttaaaaatgagatagcttgcaaatgtgaagatgatttattcaacgcaaagataattgttgtactccccttcacatatgatctacggttaggtctgccttatactgtttgctgtctattatatacatgtcactatctagacttacaaacaattccatttggttactctggttaaagcatttattttcttcaacagtcatgagtaatgcttatcattcagtgtattatgtgattaggctactagaacatttactaatcccccaaaacacacacacatatacacacatgtgcgtgcatacacacacacacacacatacacatcctctgcaggatataaataaaatagcaatcctcccctacacatgtacctggatgtatatcatctatcttcacagtatatgattaaatagctaaaattaccatacctattggacctggaaatcctcgtggaccactttctccagtgggacctcgatctcctttttcacccgggggtccaggaggacctttaaaaaaattacagttactgatcatagttgtaaagcataggaaaaatgggttagtcatctgtcaaggtacttatataaggaaatccaaagtcttctatttgttgtgcaataatatagaatgtataatactgaacttcatgaatggaggagtattctgctattcaggaatataatgccctatactaatgaggatgacattgcctcaaagtaaacaacctaacagtatattaaatgtgagtgtgcctaacacttttctatgttctgagaacctgggggcagagaaaagacagcaggctggcacaaagtcacattagtgttgtacgcatcctaggcagttagacatagagttagatataatacagaattagctactatacggaaaatctataagtaagaacttaaaagacatttgtgataccctcaagggaaaggaaaattcacacatggtagacaaccagaaagcactttgttggaactgaccataaactcagatatttgtcagtgaactgtagatcggcgtgaatggtgatggttgaagtcttcattgagaaagtaggatatgaggggtactttcaagaatgaagggaaggggaaggaagacaattcctagggattgagaaaggcatgaggaaaggcaggaaggtgaaaatgagtagaggaattcttttttcaagtaaaatattaagtagaatttctaggttgctataaatactgtaaacaaaatggagacattgcaaggaaaactttggtctcatcattttttttcaggtggctctcctgagagctgtaactaaacaaccctgatttagccatttgtattttctgtgtccagcaaaacagatacctgctcatcatgcctttaaaatgattatacctagcatgtctttagaactcaaaggtaatcctacctaaacaccatgttccatatggagtacagaggacaaataatctcttctttatctaaagaagagcacttagtttccttttcaacaccagaagaaagaaacagaaagaaacattattccatagattcaccacagaataaggaaatagtgatattttaaaggaagcattttcaattgctagtttggacacatacatagtccaaggaaaacaaatatatacagcatccctggttagaatgcacttgtttacaaattttaatcaggtgggagacataatacccgaagaaatctaagagggggaaccacataaataaataaagattatctcatgaataagtatattttgtacattttgttgttgcttattttgacatccttgactctacttctgtctattcctctggtatgtcccattttcaaggtacaatttgggttttagaggcccaagatatcattattactcttctcaatagaatgtccctttctcctcatatgcaacattggacacacatttaattgtatttttattataaaagcaactctacttataggaaacataaaagcctagaaaaagcgtgaggaagaatataattcgtagttgtgttattttaactaaagatctttaccatttctttcctaagtgtgtacgtgtattttttttttccacataatcgtcatgcaaacaacatgttacagggcttttagaaattaactggtgtattatattctaaggtatagcttaattgctgcgagacatatatttaaatgctgcacaagaaatgtaagatttctgtatcaaagggaatctctatgtgccccctattccctgcagaagaatgtagtacttcccaagaaaatggagttatggtaacttccataaccatgaacgcagctgcatccattcaacactacatagcaatgaatcccaggggaggggggcaagcaggacagacactcaatttatgcctgaattttgttgagctaattgaagggaagcacagggatagtaatcaaggatggtattttgaaaaaagtgcgcaagcaaagatttcagtttagtaactcaggatccaaagcaagacgcagacattccaggaaaaactagaacatgaaacaagaagaaacaagggacacagagaatagatctagactcttagcctctgagatggacttctcaccatttctttggtaagtaagagatggaaggaactctcctaattactaactatcctttcaattatattacatgtaattatgggaactgtatacttaattttggagtattagttcaatcacagcgaatagatcagtattattttacaaaatttggagttaaagatccctctctgtatttttatataaaaatactgatacctggtattcgaatcctacaataagaaaaacaggtaaagatttttgttagagttctaactaggcatgttgaatgtacctttttattgtcattctattcttcatgtaacattaatctcacattatgtttcatttttgtacattgttatagatcttttactgtttctaacaaaatgttggaaggatctcaataaatgttttaagtgtcttttagattcattgggggaataaaataacaaattatataccactttactcttagtttctgatgcagaacttttaagaacactatccactaccttgccaccttccaaaactagcctcctctccattcccattgtagctcacgtcttcaccatcacacagctggactattgctagagatttttaatctagtctgaatgtgttttatctgtttcacctcctagttccctcagtgttggctttcttcttctttttgataagaatccgttttgcaatgtctctatcaaattaaggaaatgcagtaacctattctgtcatattatggaaaaaagaataaagacttagagtctcttgtagtcaccttttgttcgtagtttccatttagtcttttcaaaattttgttccatactgacataataactgcctcgttgcatcaataaatggacaaaatgctacctgtcagctcccttgctgatacatgtcaaaaaaaatgggttaatattggccaaaatatatgatttattctagttcaagaagccatagaatttacattatttttcatctttaatatttccaattacagttacaggaataattcataaatactatcacaataatctgccatgaagaattacctttatacaacacatgcacaaaatctactatgtagcttcctccatgattacttcttaaaaaggaaaagtaatatttctatataaccacaaaaaagtactgatatataatatttgataatcatcaatatcatagaacaaaattacacaatttactagaaaaacaaacccaggtgtatcatatcatttaaaatcctcagacgataacatagcactaataatatctgactaagtttccagagcgatgcttctctagtttttattcattatgagcattaatcttctactccgttttcaatcttgtctcatattcagatcatcataaaaatctgccacatcttctagtctattgctgcctaaacctgcttcttttttttttctctagttttcatgctcattgatttagatatgtttaatctggaagacactttaaacattgtttaactaaacatatttatagagggtcagagagtgagttgctcaaggtcttaaagctagttgggttaaatcagaactagaagaatttcatttctttcctgatcctatgctaccatgttctaaatttaattgacttcattttccacatctgttcttccattattcctcagctgaatttttcctttacatagtggttagacaaactcacaattcagtttttttcctttggttaatttttttttttttttttttttcagagatagggtcttgctactttgcctaggctggtcttgaacttctgggctcaaaaggccctcatgtctcactctcctgaagtgctggaattatattgtctcagcctcccaaagcgctgggattacaggcatgagccaccacttctagcctacagtccagctgttacaatctcagtaattaattatacaaaactccaaattcaaatgccctcagttgctttttcattttctctactataaaaatcaatatttcttttttggtgctttcatatcctaggaagccaatatatctaaaatgtttccaaataaacaaaatgttagctattctcaccacagagtcatattatattttatttctcttaaatacctttctctagagttcatctttgcttctttaaatcacgttatccccaactctccaccaaactctacttcaccatttccacaatgaaattttatgtagttctttaaggctctaattattataactatttgagaaatgtattaaaaaatctttgtctcttttaactgtataattatttagtgattattaatataagggaaaagagaacacaaagtaattacactaactctgcaatcaacacatgataaaggataaagcactcattaatttctaaaatatggttcttaagttataatttaattaatagatattttatggctaggtgctataagagatataaagaacagtttctaatggaagtagcttgtgtccaggaagagtgaacactgttctcgaagagaatatgagatacttttatacataactatcacattaagtattctcttgtgagagaatacttaatgttccatattaagacagaaataagtatcagctgggccttactattggtagaaccagcaaaggcttcatgcaagaggtggcatcttagatggactttgaatgataaacaagatatcttcgaatacaaatcaaagagaaaatatttcaaataaaggaaaagacatgaggcaggatgcacaaagtactgggtacattagaatcacagtcaaattagttgaaatatttgatatacaaaaaagacaagcgagggaatgaagcattcaagactagttaagagacacactgaaaaagaccttgagtgctacaggcaaaactgtatgtctaatgacggggcaacagagagtctttatgcaatctaagacttcctttaggaaggctgtattctacaagggtgcaaaaaggattacagtctgggcaggaaacaattgcaactctggcaaagagtcataagaataatttatacgaggatataaagaaatgacaaaggaacagagaatacagaatgttgagaactaatggtggtcttgggagatataaaataattaaaattgatagcttggaaaccaggaagaatgacactgctattatagagtgtaacttgctaagacaaaagtcttagtttcacttattcactcaacacatatgtaattgctcacccactattttccaggcactctaacaggcattgggattgcagaggtagacaaggaggagaagacttaacctcacagagctcacattctgctggagaagatacaagctaaacaagtaagcaaatgtagagatgacatgatttcatatagtggtaaaaactatgaggaaattaaagcaaatcatggtagagagagatgggggagtttagaataagaatggtggaaagtggaggaggtaacttcaagtggagccaagaaggagtagagacgtagagaagaacctttcaagagaaagagaaaatgtctagtgttcattatggacagcatgaaatgaaacaagcactttttctatattaacttttacttgttcgtggcacttcattcttccacatttccaagctaggcagaaggatgacagagggaagattgagaaaattagggcagagaagtagacaggtgacagaccaagtagaagtttagattttatcccaagactaatgagaagacattggaggatttaagcaagagagagaaaagacacatctagtgtaaagagagaaaccacacacatccagtaatttgtgtgggttttcttaaatagcatttttttttttttttttttgctatttagaatggactaagagcagagccagggacaccaactgagaagcggatgtaatacaccagactgggatatggttgcttgaattagagtagtagtagagagtaagaagaagtttggtttgagatattgtatgaaataagaattagtaggacttacaaatggattacatagagaatgagagcaaggaagtcaaagacagcttccaagatcaggcagtgagcaggtagttggaaaatgacaaaaccaacaaaaagactgaaaacgcaacagatttggggaggcagatgcgggtggctagttaagaagcaaggatttggttttgaatttgtaaagcttcggacatttatttgaaatccaaagtggaggtatctaactgttagagaaaaatctgattaattcaaatttttctttatcatctgttttattgtgataaatactatatatgatatgtgttctgtataagcaagctataaagtacaacaataatgagaatacccttgcaacatcacaatccaagaaatcggtatctacctagatgttcccctatctcattcatctatttccttttcatagataaatattaccctgaattttgtgtttatcattttcttaaattttaaaacaatgattatattacatatttatgtgtctgtaaatttacataattttactaactatgagcattagaagtaaaaattgtctatatatagttttctgggacttgtttttattctttttttcattgtcatcacttgattattaggcttcttaattttctcaaactagtgtatttgaaatgaagtcacatgaagttcttagttctatttttctagttgctaatgatataaaatgagacaaaatattaaaatcatgaaatagagcttaacagacatggaagctggaatgagaacatccaatatgaatttcatgtaagttacagaggaaaggagagaaagaatcgtgaagaagcaatagtcaaagtgaatgaagctggttatattcccaaactgatagacataaatccactaatataagaagtacagcaaatgttagatggataaattatcaatacaaaaccacagataagtaaaactgcagatatgaaagacaaagagaatgacaaacagattggtggcagtcattttaagagccacaagaaaagcttgaagccaggggaccaattttttcagcacactgatagaaggaatcaaaataactgtcaacctaataagtgtgtatatagtaaaacaatttcaaagatcaagtcaaaatagagaaaatgaaatcagaaggtttcttgatcaatttactttcactaaatgaacttccaaaagatatacttcaggcagaaggaaaataatcccagaagaaatgcccgaggtgcttttagaacggagaacaattggtaaattcatgcgcaaatttaaataaatatttgttgtgggtgagcgatgactatctgagccagtggtgcagggttaaataatttaccaagatggttgtagataaagaaaggcagatttattaacaaaagcaggaaaatacgttgcaaggaggcaatgagcaggccagcagaagagaaactgattgccaggaaacaaaggtttgctgaagattttatagaatagtgtttataacgtatgctgaagagagcttgtgcagtactgataaaccaaggttagagtgggttaacttgcaggtatctggtgacaagtttcttgcaggagggacctacatgttctggaccaagaagaaaggcagatttatagcttatcttctttctctttgctttccctggtcctaccagcctgactacttttccctaattaaggctccacaagattgtctgtataaaaaaagaaaaataatattgactaagttctcgattaaaaaaaaataaagtagaataaactgtactaaaatattagcaggaaactagggaagaggatcatcaaagcactttcagttccttgtgtattttaggatgaatgttaagatactgatcaactttagacttcaagataaatgttaaggtcaacaatcaataagaaatagaaatatactacaaagtttctgaaacctgtttggtaattttggtagagagaaaaattcagcaagagaaaaatcttaatcaatccaaaagtggcaatacagcaaagcaaaagaaacataaaataaactggaaaaaaccagagcacatgataagatagtggaaataaatacagtgcaaagagatggtcagattgtatatttttttaaaagaaaaggtaagtattcattacaagagactaacctaaaacaaagaataccaacaggcaaaaggttgcaatcaaaatatagaaaaatacatgcaaatggttgaaatcaaaatatagaaaatcaaaatcaaaatatagaaatcaaaaaatcaaaatatagaaaaaatctataatgtaaagctaaaactaaaatatctaaaatgtaaagctaaaactgaaagcctatatatataaagaaagcatatatacatatattttatttatatatataagtaagatccaattcaccttatttcactaacaggcactgcagaagaaatggacaaatccatcattattttggagagttcaaaagatccttttaattaataatacagtcaagtaagaaataaaaaagactggaagttttggaaaagcaatattaacaagcttggtttgtgaacatgtgaagaaacttgtaattacaaaaaacttgtattcagtacttatgaggtagtttttaacaatgagaaaatcattagaccttaagatatattttgcttttccctttctatttaagtgataccaggctactggttatcgtaccctgtctttatctgattttcatattctttcctttgggtatttgcagtaaatgtaagctcagaaactatttatttcaaaccataggatttcaaatatcaaatctctgcatgtatcagtatattttaatatatatatcattttctggagaaatgacaagacattttaccttgaattaaagtgatatttctcaaggtctgagaatgttcccaatctttcagtctgagatcattagtgatgttattcagtactttcacttctccttttatttcctgttccaaatgcacttgttcttctttcatagccataatttctgctgatacattgtaaacacgctcctctaatttactgatttcctgtaaaacataagtgagcattcacagcctttgttacatacataattatcaaatatgaaagttcaagaaaccctcggagttcaggtttttaaaaacatattatgggagttttatggaataagaatatagaaattagaaaactgttttgaaagtagtaattctttaattgtgaaacatttcctcttttgactgaatggctgaatgtttacaatcacaacccccttcaaaaatcaatttaatgtatctatgatatgtttctattcctatatatatagatgtcaaaattctaacaataaaattaaataaacaccataaggtcttaatttatctgaagtaaaatgtcttcgtactgtacttacagtggcaacatagtcaaatttcgtgaatttgatagatttatattggaaattgttttatagtaataagtgaagtttaatgtcataatcctcagtggtgatgatcattgacaatagattttcatactcaataaaacctcgaactcgcatattaacagtgctttactttcagtttgcattgcctctgtatttgaggcattagtattttgtgttttcaaatacacgtatattttgtgtatatttatacatacacattcatatacttaagagtgtgaaaaagacagaggatctacctatatcctggaatatgcttttatattttactcaataatatattaaggatatttatctattaaaatactttagagactgatattttcagtaatttagtggaattgaatctatttctcaaaatttatttaggattcctattcatagtgttttgagctgtgcacttttctacaactaaacaatgctgccatgaacatcattttaaatatatttgtatattgatataagtacttctatagaacatcttcctgaagtggatttgaccaaagggactaaacattaaacagcatttttgttcaaccattgccgtactactctccaaatatatgctaccatttttcttcctcttactgcgtatcagcgtccactttttgcagctgaatactgggtaccattaatatatttaagtttgcatagtaagagtaggtacatagcaaatcattattacttaacttgtttttcaaattatagtgaggttaaagtatccagtcattaaatttctgacgattaatgtttattaatttttcttttagatcatttgcttggttttctctttcagcattgggctttttatttttgatgaaccaaatgttctcatctattctggtaataatttttgtctctctgttctacttttatcccattttctgtcttcattgtatgctttattattgtattaagtactcctatgttctaaagttgatagatactcatttccgatttgcacatggggaaataagccagtggtatgtttttctttaatccagaagtaaaaagaatattacactctcttgagctggactagactagacaagcttaggtgagaggatcaagatggtcagagtgtaggaccttcgaaaataaatgaatgtgcgtctagatttgcctcttcaatgacactatactgaagcagagagacttaccagcttttattgctctaactgtgccttctcccaaacaaaaccttattctagattagaatttctctatcttgcacctcctcctcccctgaccatttaatattttctgtacaataccatcattacaataaaggtgaaatagtgagcatggatgtttgtagggcacaccgccatgataaatacacttgacttaatttagggggctaaaaattgctgcaagtatgtcgggtagttccagacattcagcataaagtgttaagtgactagacagtgattttgcttcctagaaacgaggaatcatccaggtttttcatcatacctaaaagctgaggctactttttctttcttttttttttttttttttttttttgagacggagtctcgcactgtcacccaggctggagtgcaatggcatgatctcggctccctgcaacctccacctcctgggttcaagtggttctcccgagtagctgggattacaggtgcacactaccacacctgactaatttttttttttttaattttgtagagatggggtttcactatgttggccagactggtctcgaactcctgacctcgtggtccacccacctcggcctcccaaagtgctgggattacaggtgtgaggcactgcgcctggcagctgaggctgccttattattcccttctttgaaaactgcacatggtgtttacatttgtcaaatttcagtggaaattattttcactgggaggaggaaaagtgtatttaatttcaaaaaatcctatatagcatccacacactccctccacatgctaccaccagtgaccctcctagaaacaggcatttaattttgtagtcgtacagtccttttcacctctatggatgatgataaatgccacccctgtctttcatttggtgccaatgttcttcctctttctttcaaattaatttttggtgtgtccttgataagtgttatgctggtgtcacttataacctatttcctcaaacgccatttacaaattcaggcattcatttaatttatttattcctacattgagctaaagattcaaaggtcaataaaattattcaagcaatggggatgagcgtcccaatgttgtttttcagtgtacacaggagtacacacacacacacacacacacacacacacacatgcacgcactggcactgacctagtttctaagtctctgtgagtgactactgtttttaaagatgtatatagctttcaaactttcaccattcccttgcatttccttttctaatgctggaattccctccaaaatttaagtgtaatctatcgaaactcaaacagctcactgatcaccagattttgatcgtttccattaattatcacttcaaacaggttcaaaatttctaccaccttccagatagtttccaatttgctttcaattcctcatgtttgggttcaaaagcattcgatggtcagccaggcgcagtggttcatgcctgtaatcccagcaccttgggaggccaagacgggcagatcacctgaggccaggagttcgagatcagcctggccaacatggtgcaaactctgtctccactaaaaatacagaaattagccgggtgaggtagcacgtacctttgatcccagctacatgggaggctaaggcacgagaatcacttgaacctgggaggcagaggttgcagtgagccatgatctcaccattgcactccagcctgggcaacagagtgagactccatctcaaaaacaaacaaacaaacaaacaaacaaaaacattccatggtctctgcaggatttaatgcactgccagaatcaaatgtatccttcttcttccatctcatccaccttccctctgtccttacctcatctcagtgctcttctgaccctatttctacataaatagtatttcttctccattcttctttcccctcaacttaatcaatgtctatcctgataactaacattttcgctttctgtctttcttatattattcaaaactatggacagtttcttctttgtacactttctctaatctttctatagcccaaggctttgatatcccaataccctttgatatgcttacttattaacaatgtaggaaacactgatagattttagacgtgacatggaatagaaacggaatatcaacatgttgggatgaggttcaccaacagactccccatacaaaaactgtaataccattgtcttctgacaccttaaggtgaggaccatgtataagttcaaaagttctgagtgaaacttacaaataaaaaaaaaaatctaagcatatcaaatatgtctgttgcaaaattcacacatacagagtgttcacttctcaagatctgctaagataacctaaaaattatgattggtttaggcagtctaaaaagacattttaacagtatttataaaatatgtaaagggagtctatattcaatgggaaaaatttcccctttttctaagagtttagagaaggcgaatccattttaaatcccttaacattcgtttaaaatctggataagttagccatagaaatcagggtaaacaggatgatgaaacagggtttgcaacttttgctttcctgtactgcctaaggagacgagacttggatggattcagttccagcaagtgaccttgcagtccacaaactcttacctcttgttgtttgaaggtattctcttggattttgccattcagattttctatgttgagctgcaaatcaagcaatgtggtattcaaacttattaaggacttggagatttcatctattgcattcccatgtccctggactgaggaaaacaaggtacttagctgcagaagaatgtcattaaatctttgatcagttgtcatgctgaaattttggaaatgctctgtgtccatgaggttggcttccatgtctaaaatatgctggattctcttctccatgttgctcatgtgttccataaagacttcttgaaatctcatttcctcttcgctgtcatttccttttcccgtgagactttgagttatatcatttgcattagttgaactaactgagcaattcttcgtttcccacttcaggagttgagctgtatatttaagtaaaaataaaccagtcatggcctgatccttgaatgcatacaggatcccatcccatatcattccattccgttcattttattccattccattccaacattttgaatgctaggctaaatcgagtatttttttttaatctacaacgtgtgaactacgctacgtatattgctgagaagcatacattctccctttcctattttacgttaagatgattccaggattatatcatgctttctgaattgctgcttatatgaatcttcttggccattgattttggccttgccaattaaaaaaaaattctatagattatgaaaggctatgtgtctacagaactgctgttagaataaagtggactaatgcttaatacagtttctgaagtaagcatgttgaatatgttaacaatggcagtgataatcatgatgatgacaaaagcaataagtggtgaaatagtggtgtcatgcataatatggataaattgttggtttatcttcttcattctttcacttgagctgccagaaaagcgtcattttcagttaatacagacctaattcacagttggtggagcaggaaattgggcaaatacattttttcactttataaaggtacgattctcataagactcctttttaactattataaaatatatattcacagcagaaaatttagaaaatatacataatatggaaaaacaatttaccatgaatctcaccatcctagcttaaactctaggattttggtgtacgtgtctcaacccttatcatattattatcttaaaatatgacatttttaaacaatctggaaacaactttttaatgtaatgctctatcataagtacttttttatattatttaatattattctacaaaaataattttaaaaactccattgtagtatatgtatggatctgccagatttatttaaaaaatagctgcatttagtttgcctctgttttcagtaatatagccaatgttttgatgaacaatcttgtgattaattatttcccaaattaaaaaaaaattatattctaaaatagtattttaggaacatactgagctgctgatagatatccccaaatgggcatatgttctctaaacaatctaattatcattctgaaataatctaaagcaatatgttttctagtttcaaaaaaataaaaggcttaaacattaactttttatgcaaaaataggccgggtgcgttggctcatgcctgtaatcccagcactttgggaggcgcagggaggtggatccccaggtcaggagatcaagaccatcctggccaacatgatgaaaccccgtctctgctaaaaatacaaaaattagccaggcgtggtggcgggcgcctgcaggcccatctactcaggaggctgaggcaggagaatcacttgaacctgggaggcagaggttgcagtgagccgagatcacgccactgcactccagcctgggcaacagagtgagattccatctcaaaaaaaaaaaaacaaaacatgaataattatagagaatgaggaaaatgttaaacacaatcttatcactattcagtcatggctgaggttttctgttttcctatatctctctatatgtatctatttataccttttatctacatgtatgttagtcatattcatattagattggttgtataagattttccgcatttgacaattatggaacaataaaaagaataatttcatattgctcaaaaatatatgcagctccacctgagtctatcaattttctaataaaagtgatatggtgatagtaccatttttatagatttttgagaattaaacaacacatgaaaaacatttagttctacccctaactcaaggattttgttcaataactaacagcttggtgtttacataggatctagttccctgattctagaatcttcctacactcctccattaccaactaggctactctgaacaagttacttatcgctctccttgctttggttttctcaatttgtaaaagtaacaattacctcaacagtggtgctgaacactaattaaataggcatatctattcctctaaagtgccttgtacatgagagacattatctcagttacagagtccaccgtatttactacctttacttaaagaggctgtgtgtggatcacctgaggtcaggagttcgagaccagcctggcaaacatggtgaaaccccgtctctactaagaatacaaaaattagccaggcgtggtggtgggtgcctgcagtcccagctgctcgggaggctgaggcaggagaattgcttgagcccgggaggcggaggttgcagtgtgccgagattgtgccactgcactgcactccagcctggctgacagagcaagactcagtctcaaaaaaaaaaaaaaaaaaaaaagaagctgtttgataagcattactactgtagctattattacattaagagtgtcatcctaaatatgcagttaaattctaatttcaaaaaatacatgataccatatttttccttgttttattaatttaatattagcttatgtgaaataacaaaatatgacaatattttgatgtgatctacaatagagtttgtattgagtatgttactctacatgtcttaacgtatcaataccttggaaataaaagtatatttcttaactgtatctcatcacatttattaaattcattgtggggaccaagttttgggttgacagcctcatccatgcattcattaattctatgatttaattcttatatactatgtggaaagtattgcttgagttactctgggaataaaagaacaattgggaatggaatttgactgtaacaatgaggagcccaaataaacaattttatcaaaattacttcaaaattttcctctaacgttgtccttttttgattattatttcttttgaagtagcagttaagaatttagattctagaatagaactgcctgggttagcaattctggctctgccctttataaactatggcgttggacaagttacttaatctgttattgcctctatttcaccacctgtataaatggggtactaatagtcagtgtccaaataattaaatgaactatatgtaaaatacttagaccacttcctggcatgtaataagcacttgaaaagtttcaggtttttgctatgattaatatttggattcaagatgtgtgattcaggtacctatatgcccaatattgattaactatggggaagtagcattgtgtgataaaaatctttttctggagttggatgttcatatgaacacagtcatctctctgctttattttactatgcacattgctctgattgctcaaccatatacttttactttcactggaaataagatttattttgtatcagtaaagctaatatttttcacaatatggaaagagaagccccaatgtgactaaggtcatatgaccaactatttttaatttgacaacaagttaaacatgaggtgacagtaaatgctacattttgttaatagatctaaaaacacaaattgcctgtttcatcgaaccctgagtgaaaactaatttttctataaaatgttaactttttatcatatatctaggtaaagaatgccaggatttatattttcaaaagttcacttatttttattggagagatggcattttgtgacttttctgtttcacatatgaaaggagacagaattttatggtctgtgcaacaacctacggacagggttatatttgattctacagatcatatctactctttcatattggaattatcttttcataccccaaatggatattgttttcagctaaagaatttttagtatttcagtaacaatttatatatatatacataaattcttgatttttatcttattgttctgacacagtattatgttgttacactctgacagtatttcagcagcttctttaagaaaagattgtaaatggaataaaccttataattaagaaaatacccctcaatatataattcacttcacagagttttatatataatattctatttcacccatgaattcatatttgccaaacttctaccattttagggatatattctgtctacatttgtaattttttatgccaagtagagatatatattgctttttagtttctttttgaaaaatatactgatctacaacttaattaaagttgtaagtggattgtgaattgtttattgttaatacataataaacatagtgaggccttttccaaattctggtgaatctgatactgatgtgtacttataaaatttgaacattcttagtgtctagtcaattttagtcggtacctactgtagtttcagtaaacaaactacttcaaatcaatcattgtaaactccagaataaatgtgttgacttggtagtattttctaatagctcggggactttgaacttggttagaaccttgaattattttccgactcctgtctgcactctgcacgagcctatcagaagctgcggtccctggtgctggtactgcaggcagtgatttgcataaaggtgatgaaatctactcaaattctaattggtttatatgtaataatcccaacaatgaagcatcatttagttatacatttcaaattacagataagcatagacataaacaaacatacagataaccttgatttaccaggaaattgtttaatgccaaacgtgtcaggtccttttactcagacaacaatagtttggttggttggttgttatggttggatttttgttttagtgtatttttaatggccaaaaagaagttaattgttacctctagaaaatattttcctgtggtgacttttttgttttttcttttttttttgagacggagtctcgctctgtcccctcaggctggagcacagtggcgcgatctcggctcactgcaagttccacctcctgggttcacgccattctcctggctcagcctcccgagtagctgggactacaggcacccgccaccactcctggctaatttttttgtatttttagtagagacgggttttcaccatgttagccaggatggtctcgatctcctgacctcgtgatctgcccgcctcggcctcccaaagtgctgggattacaggcatgagccaccgtgcccagctgacttttttgtttttttattggccaaccatgttgttttataaagacttgattaaactgggagacaagagaccagagtaactcgggttcggaagtcttggatgggaactccagctccaatactgagctgtctgaattttcttatgtggataatgagaataattacagtctctgtagagaggttaattgtaagggtgtattattgttttcattatttctttcttagtggaatttttgctctgtcttggaatacttccttagactgccctgtagcagaggaactttggcctggtctttaggaacttttttgttgttgttgttaaactgcttagtatgcacataaaaatgtatcttattcccagcctatctcttattagagcacatgggcagacattttatcagtcatatagagaagaggagagctataaggcatataaattcaaatgccaatcgaaatacatcaaatccatccaaaatgctacgcggggaataatatttacataagtgcttacggtgtatacaagctatctacccttgtagaaacagtcaaatctatctccggttcaagtcagaccctccaaagaaatatatacctcaggaacatcattttgagcccaagtatcacgttgtatattttttctttgagaagatactatcaggttatttttagagatattttaaataatatccctatgaaaaatgtggtcatataagctggattttactaagttgtaggccattattctacaaagtctcctctctttaaaaactgacagaaatattttttctgctctcagtactaagaatagaagagcttctcctggacaacaggctttttttttatattatagctattgttaatgtaaatgatcatcttacttcttcacattggcaaaatgaatacttttaaaatttgtcacccacattagaaggagaggactctagaggataatatatttttgaaagagcgtccttttcattttactattacaaatctgtatttttatcttgcacttctttttttccattctattttgttttttctaatttaaaaactatttttttctacttaactttgcggaatctgttttttaacttaacaaatttgaaggacactttgtaatgcagtattttctttatgaatgtaccatatacaaaagactgaatgcttcttttttgctttggcaatgaataattcacgggacgagttactaaatttcaaaactctgggttacgttacctgccactattccaatgagagggatgagaactgcaaacacgaggaggtaaagggcaatcagtgcagctttgaaggacttcagtttctcttgaagggaagggctgtttttaggatctaataaaacaaaaaagcccagcctactgttagaaagtgttgtcttcttccataattaaaattgttttaatctccaattatattcttactaccaagcctattggaataaaaaagaagaaaaaatgttccacatctttgcagtagaaagcaaaaggacagtcacaggaaaagccaatccaggtatcattataggcacttgactgacttatccactcactaaacatctacaagaaagttactgtgctctacaagttgtgcttgtttgatcttttggaatcagctggtaaattttaatatcgacacttacatatacaaacataaattttattcaatgttcatatgggaaaatattctgggtgacaataaaattttctaaagtaactatgcaattttttaatattttaaaatcagatagggcaaatacttattttcaatgactatgatgttaaaataattttcttgttcaattccttctcaatagttttgtatctgcatacctcttatgatttgaatacagtgtaaacaatatttaagaaaaatgaaataaagtgattcacatttttactaatctttagaatggatcaatgaagcccactctctctatatttcagaacatattaataacagtaaccttttattcatatgcatttatatggcactgtgatttatataatgggatattaattgtagtagagacaaatcaatataaaggggaaacagtagatgaggaagtcatttctctgattagttgaatacaatggtcattaaaaatttattttctatggtcattgctttcattgatcaattaaaaaaagtaaatgttgctttcaggttgcaaattgttaaattaaaaacaaacttttttattttaaggtattgaaaagaaaataagagacagtttttaaaaagtaaagaaaagagaagagctggatgcagtggctcacgcctgtaatcccagcactttgggaggccaaggcgggaggatggcttgagcctaggagtttgagaccagcctgggcaacatggagaaaccctggctctacaaaaactacaaaaattagccagtcatggtagcatgtccctgtaacccaagatacttacgaggctgaggtaggagaattgcttgagcccaagaggttgaggctgcaatgggctatgatcgcaccactgcactccagcctaggtgaaaaagtgagaccctgtctcaaaaagaaaaaaaaaaaaaggaaaagagagaaaaggaaaggaaagaaaagatggaaggaaaaaagaaaaagaacccataatagaagcaagtggagatatagtccacctgccaggttgattaagcctgaaaagtaggagtcatcttctcatctctaatttatcatcacaaatgtaaattctaccttttaaatagctctcaaacattttgattgctttttctctgctcccgatgtctctctcctccttcttcaaactctcatcatttctgtctgtaacagccctcactgttatcttttcttacatgtgtctcacttgtgccatatcctcccatccatcctttacacagagcacaagatccactgtgccctggagttgaggtctgtatttcaggtttgctatgtaagaactcatatatgaggctttaactttgtatatgctgcttcttcacactgaaatatcttctctttcttttctgcctccacccatccccttagcgatatgtatttatattttgaggtttagcagaattataagtaactttctcctgacatcttaaatgatcctgttgagatacagctgagtattgctactttttagctgttgtcgtaacctgtgcaaacatgtttcaccactgctatatgggttgaattctgtgccaccaacagatatgttaaagttttaaccataggtaccagtgaaagtaagtttatttggaaatagggtctttggagatgtaatcaagttaaaatgaagtgatattggattagggtgaaccctaatctaatgactgatgtctttgtaagaaaagaacaaatagctacagagagaagaccatacgaagaaggcgggaaagatgagtggtgcagctacagaggcaaggaacactaaggactgccagtagcccgtagaagctgggaggaggcacaggaagattcttctctagagccttcgaaagggcacatggtctttctgacacctgcattttagacttctgcatctcagaactgtgagcgaatacatttctgttttaagcctcccatttgttacaacaactctagaaaactaatacaggcacctaccacccatgattttcgaatattagctcacggtgctaggatcatatttatctccagaacctaatattgtagctgggaagccagaaggctcaatcaatgttgtagattaatttaatttcatataatactgccttacttttatttaagcttatttttattctgtctcaagaatacccctgttggtcaaataagtattattttaacatccacttacatttaaggtaagtctcaagactataattttatattttgtcaataactctaagaacaacctccatgggcagcccatccccctctacttactcggaggaagcaaagctgtcattgagcgagcatcaaatttcacagattcggagcagctatcagtgtcctcctgttgattgtgaaagtgatcccactgctccatacttctatgaaacaaaatggaaaaatatattaattccacatgaaatggctagggctcttttgcataatgttttaaactgaaatttcagtttgaaatggaatctattcagtttttcttttttttttttaattatactttaagctctagggtacatgtgcacaacgtgcaggtctgtcatatattatacatgtaccatgttggtgtgctgcacccacaaactcgtcatctaacactaggtatatctcctaatagctatccctcccccctccccctaccccacaacaggccccagtgtgtgacgttccccttcctgtgaccatgtgttctcattgttcaatttccacctatgagtgagaacatgcggtgtttgggtttttgtccttgcgatagtttgctgagaatgatggtttccagcttcatccatgtccctacaaaggacataaactcatccttttttgtggctgcatagtactccacggtgtacatgtgccacattttcttaatccaggctatcgttggacatttgggttggttccaagtctttgctattgtgaatagtgccgccgcaataaacatatgtgtgcatgtgtctttataccagcatgatttataatcctttgggtatatacccagtaatgggatggctgggtcaaacggtatttctagttctaaatccctgaggaattgccacactgacttccacaagggttgaactagtttacagtcccaccaacagtgtaaaagtgttcctatttctccacatcctctccagcagctgttgtttcctgactttttaatgatcaccattctaactggtgtgagatggtatctcattgtggtttggattagcatttctctgatggccagtgatgatgagcatttaaaaaaaaatgaaacggaatctatattctatgacacaatctgtaataaataacatttaattttagcaaaaaaaccataattagttaaatttgtatatctctcatatacagcaatgtattaaacttacccataagttttaactttcacgtaaaaagacagatgtatgtggaaccctctcatgtatctttctatttacaaacatgtatgtctatttttagaggtgtgttttttgagtgtggaaaaagaggtatctcttctttcttagctgaaaagttttttacaggtgacagaaaataacttgtaaaatgatttaatcagtaatttaatagagtaaaaggaaggaaataaagaaatgtctggatctgaatgatctgatttgacttcttacaaaagtcaattttcccagataattgttttaatttgcctctatctgacaaaagagaggatttgggaactatgcctgccttcctccatcctcttcctccacaatgtttaaatccattagagaacatagtccttgtccatatcaacataggattcagaaaaaacagttctcagaaatgatgcacatacaaattgtcattgcgaactgccaaataaggaatttccttagtattattttaattactctatttgctgaaaaaacaataatttcccttaggacaaatagttttgcatatttggactaaataaatatttcctggatcttttaagaaaattatttattggccgggcacagtggctcacgcctgtaatcccagcactttgggaggctgagatgggtgaatcacctgaggtcaggatttcgagaccagcctggccaacatggtgaaacacagctctactaaaaatacaaaacaattagccaggtatggtggcacctgtaatcccagctattcgggaggctgaggcagtaaaatcgcttgtacccggaagacagaacttgcagtgagccgacattgcaccgctgaactctagcccgggcaagaagagtgaaaccctgtgtctcaaaaaaaaaaaaaaaaaaaaaaaagtatttatttatttatttacttattttgagacggagtctcactgactctgtttcccaggctggagtgcagtggtgcaatctcagctcactgctaccatgttgtccaggctgatcttgaactcctgacctcaagtctgcctcccaaagtgctgtgattgcaggtgtgagccattgtacccggtctctctctttctctctgtctgtctctctctctctccccttctccctctctcctctctctcccttctttctctctctctcccttctctcttctctcattcactctttcactttccagagcttttctcattttacattggcagccatataaatatgtccttgtaccttttccagcataatctctattttatgtgcatactaagcagcttttaaaaatgttcctgtgtctctttaacatgtatcagaaacattggaaaggtttgataaaaagaaactgatgggcctcaccaccagagtttctgatatttggggtgggggctcaagaatttgcaattccaacaaattctcaagaggtgatgcaattggtctgaggaccacattttaagaaccttttccataaaaggtgattatgacttcttttgttggacacagttccgttcatgtgattgacaaatttagcataaagccaacatcttctgatcatttcttattttcttgaatgctgtgtaatggacttagcacagcacagttctaactgagtgcactggcatctttaggacagcaaagtcaaatccagctcaggaaatgaagggcgatcattcagatgcaaatgttcatcccactgtggggagaggcagtgacatgcaaggatatgactcaactcctgtcaatatattttgaaaatatcactaagaagattctttatttggaagtttgcagtgacagtcgttgcatattcctcctttctgagagttggttttcatgaatgctatgttgatctgaccaaggactctgttctttaatggatctgaccactgtggagaaagggaatgaagggaggtaggcatagaacccaaatcttctcctttctcaggtagaggcaaagcaaaataaataaacaattatctgggaaaatgaactattgtaagaagccaaactggattatttagatccacactcttctctatttcctccctttattagatttaaagagcagttttactcaccaagcaaaacaaatgaacaaaaaaaccaaataattaaaaaaaactgacatgacaataaaacttagcaaaattcactttaaaatatagttgaataattcataatcctttgggaatatacgcagtaatgtgattgctgggtcaaatggcatttctggttctaaatccttgaggaactgccacactgtcttccacaatggttgaactaatttacaccccaccaacagtgtaaaagcattcctatttctccatatcctctccagcatctgttgtttcttgaattttaatgatcgccattcttggaaccaatccaaatgcccatcaatgatagattggataaagaaaatgtggcacatatacaccatggaatactatgcagccataaaaaagagtgagttcatgtcctttgcagggacatggatgaagctggaaaccataattctccgcaaactaacacaggaacggaaaacaaaacatcacatgatctcacgtataagtgggagctgaacaatgagaacacatggacccagggaggggaacatcacacactagggcctgtcagggggtgggaggcaaggggagggatagcattaagagaaatacctaatgtaaatgatgggttgatgggtgcaccaaaccaccatggcatgtgtatacctatgtaacaaacctgcacattttgcacatgtatcccagaacttaaagtataatttaaaaaaaaaaaagaaaaacgaaaaccctatagtttaaggcaattggaactatgtactaatgctttttaactttgaactcagtttgtaaaagatggattcgcaaaaattgtgttcaagtatacctggtatgtatagacatgtgtcaattaaggacaaagatacgttctgagaaatgcattgctagtcaatttcatggctgtgtgaacatcatagagtgcatttacacaaacctagatggtctagcctactgctgctaggcaacaaacccaccccaggctgtgtggtctagcctattgctcctaggattcacacctatatagcatgttatactgtgctgaatcctgtaggcagttggaacacaatggcaagtatgtgtgtttctaacatatctacacatagagaaatgcagtaaaaatatggtataaaagatacgaagttctgcacctgtacagggcaattggataaatgaaacttgcaggactggaagttgctctgggtgagtcagtgagtgagcggtgagtgaatgtgaaacactgtagactttataaacattgcacacttaagctacactgaatgtataaaaaattttatttgttcaataataaattagccttagtttacagtacctttaatactttagaaacctttttaaacaacatttttactcttttataataacacctggcttaaaccataaattgtgtagctgtacaaaaataatttctttctaaacagctttatcctataagctattttaactttttttttttttaatgtttctacttctttaacttttttgttgataactaaggcacaaacacacacattagcctaggcctacacagggtcaggctcatcaatgccactgtcttcccctccatatcttctcccactgaaagatcttcagaaacaataacaggcatggagctgtcatctcctatgataacattgccttcttccagaatacctcctaaaggacatacctgaggctgctttatggttgaatctttttttataaataggaggagtacacaccaaaataatgattaagaagtataatatggtaaatacataaaccattaacatttattatcaagtattaaatacttacgtaactgtatgtgctatacttttaaatgactggcagagcagtaggcttgtttacaccagcatcaccacaaatatgtgagtaatgcaatttcctattcccttagaacagctatgaggtcaataggtgatagaatttttcagctccattataatcttatgggaccaccatcatacatatggtcctgtgttgactgaaacattattatgtagtgcatgtctataaccagaaaagctttcctttcaggctacctactggccccttctccacatgtttgattatggctttgatcctcacatttgagatattctgcctccatttttactgaaatgcaaaataaacagctcagattattctatctaccaggtaagaccgtttgtgaaaaaagctgaagacttttgaatctgataaacatctttacactctgaactctgaacgagtagggaccatgtctgcttttgtccacattatgtcactacagcctaaagcaacctggaacattgaatatattaaataaatattgaatatactgaataaatagaatatgctgaatattcatatatgaatagatgaataactatatagatataaatattcattatataattacatctataacatgtaatacatatttatatatacattatataatatataatttatattatgttaatatattacataatatattatataataggcaaatatataatatatataatatataatataataaatatattatcatattaatataacatatattataaatatatatttcccaattatattatatgtaataccatatatatttggcaattatataatatataatataaatatatgtataattatatgtaatttatattatgttaatatattatatattatattagttggcaaatatattatatattatatattttatatatcatagaattggcaatatataatattaaatatatttatattattatataatatataattatatatatatatatggcacaggcatagtacaaaagtgagtgattaactcttttggggaagtgggtaatcaaggtaggaatacagaaaagatgacaatgaatcagggttttgaaaatgagcagaatctggggtaaggtcattccaggatggaaaatatcatgttaaaaagcatgaaggtatgaacaatatggaactgagagcagttttaatttttcataaagacaacatttatttttcaccttaacatttatttttaatatgccttacttaggttaagagaaaacaaagatttaaaaagccaagtgtcccttttattattatactttcttttcacataaccttttcagcctagattcaggtaacttcctgtctctcccattaaaggagaggggtcctgcacattacaacaggcaaaaaaggctttcaggaaataaaatgttttaatttgatctattacatctgttcaattttcttgagtaccttcgagagtgggaaaaagacaaaaggagaaaaaaatggtattttaaacaaacagactataataaccttagttaggttggtagtacactatttatgctttttctctaaacaggtacaaaggaggttcaaaaagaagaggctggagaggcatgtagccggtagcatccgactcatcaatttcttcctttatttttctgatcgcataaattgatctggctttcacaacctacccaaaatataacattgaattactatctatacaaatgaagtaaaaatttattgtttgctttggcagtagtgacctggattaatattattagtgagacaatatatattgtttatgaaacattttgcttttctccctttcactttgaactagagatgaagcttgattttgttttttctttaagtttctaacctttgatttatttttttttagcatatagaagtgataataaatattttgtggattactatattttaaaccgtggttaccttgggaagatttatttaatctctgaaaaaggaaaaccacctagtacatgtctatgagtgatttagactaactgacactatttagtctataaaatacccctgacaggtgtagtgggccagaagggaggtgaacactgaagcatactcagtgcaatgaggaatgaacaatattccctatggctacatttgtgcaccatgggaagtctgtttgctttctgggcaatgttcaaaagggattggtttatcatgaactgcacgaaatgttggtatgtatattttccagaaaaaaaaaaaagctcacattcatcagagataatgaagccataggatttgtggcattttctgatgttactttcttttttcttagtctgcacagtctctctgagaatctcatctacttccatggcttgaactactgcctgtgtcctgatcaagccaatatagccaaaccagatctcaatctcagcatcagcttttgttttacataacacaactagctacaaacgtggattttctacagcaacctaacttttctttttccaggattttcactgtggttatatcatccatttacatcatctatttattatcatacccacttattattatcatctacttactgtatagtggagaatatgtgatatagttaggaatatgccggcaaagcacagtcacgcaatctgagcccagaactgcttttctagaccgctctcatctataagacccatatctgactgcacaaaaactcctgatttcctttgatccattccttccattctattccaatttttggacttcggcttatttttatctactccagccaggcatcttgggtaacagcaatggtgcagacaattaagaggaaaatccaagggcattaagagagaggacaaattaatagcatctaaaacacagcattttaacaaagaatcgtagggaaaaagtcaaacagtagaagataccttttttcaggaaaaaaaaaaaaaaacaccacacacataaacttgaaaaacatgatattcagtgggtgagtagaggaagaagactcagcacaaaagacaaggaagaactttttgacgctgcaagagaaaaacaagaagcagtcagggtcatggaaaagaacaaagaagttcgtggcctgcaagaaatccataacctgccacatagaatttaagttgtttttcctgtgtggtagaagcagaaataaaaccttgcaagattggcagtaataaatgtataaaaatgaaagtccctgagtgcataaatgaaagttgttcatgctcacggttttttgttgagaagagagatactgatgattgcactgagatagcacatccaggggagttttatttatttctgggtattcctcctcatctccccaacgtctcaacagcagagtgagccagggtccagtttctgttctgttttctctcctattttcactcccttggtgatctcactagcctcattgctttaaatataatctagaaggctgatgactcttaagtctttatctcttgcccatagctcgtctctcaactacaaacccatatatgcactgcctaacaacacccctgcttagaattctaatatggtgcaaacctagaggtcttcttttcctcgccttttctcatccactacatccaatctctcatccaaccctgttgctttgttttcaaacgctatgtagaaactgagggcttcttgtcacttccttgctagcatcctgtccaagccccatcatccctttcaccgtgacatttcttttttttttttttgagacaaggtcttgctctcttgctcaggctggagtgcagccgtgtgatcacatcactgcaaccttgacctcctgggttcaagtgattcttccacctcagcctcctgagtagctgggtctacgggtgcatgccaccatgcccatctagagatgcagtcttactatgttgcccaggctgatctcaaactctttagcctcaagcaatctacccacctcagcctcccaaatttttggcattacacacatgagctattgagcatggcctcaccttgttgattttaatagctccctgactttcacgcttacattcttgaattaattctccacacacttcccagaagaatcctcttaaaaagtaaggcagattgagtcactcccatgctcaaagcccctgaatgccttctcgtctcactcaggccgtcattaaagtctgactcaaaaaagcagaccacctgtaattcctgcactttgggaggctgaggcgggtggatcacctgaggtcaggagttcgagaccatcctggcccaatgatgaaaccctgtctctactaaaaatacaaaaaattagctgagtgtggtggcgggtacctctaatcccagctactcagaaggctgagacaggagaattgcttgaacctgggaaacagaggtagcagtgagccaagatcaggccactgcactctagcctgggcaacaagaataaaactctgtctccaaaaaaaaaaaaaaaaaaaaaaaaaggaaagaaagaaaaagcaagcaagcaagcaagctgactgttcctgaacatccattttcaacctacaaccccttggggctttgtcttccccaccctggcttcattttctttcccccaaaaacatatattccttatttgtcttgtctatcatctgtcttctctcatccaagccagatccatgatgtggacttttgatctctttggttcagggatcagagagttcctgaaggtgctcattacatacataatgccgtatttaaaattacataaataaatgaaaggcaagatatttttcaagatgactggattttatatcttaggttatgcctcaagaaaactttgtggttcactaaagtagggattttaaaaattcttctgttacatattggaaaataaaatatttctctctgcactgcacgtaactagcaaactgaaacaaaaaatattaccctcagtgaacccactttgcttcaaaagcatttattattaaaattaccagattatttcagctgcttactctggttataatcattgtaattttttagtaacgtgaacatacatacttgcatgagccttcattagcaggcagtgaacaactcacactgttcaagtgtgccttttaatatcagttccacagttaggacaaaaagtagcttcacataaagttactcttcctattaaatgtcagtgtgctgataaacgattgtaaaatccttggagtttgtgtaatctattaaaagcacgtgctcatgagaagtgaaacacgtttctgtaatatcagcattttatcaagtggatgaaaagtttacaggaaattcataatgaaagaatttcaaggttaatttgttgggaaccatataccttacttttttgtttttattataaaacattttaataatattatagatatgttaggatgaaatttctgtcatctcatcaccctaataaaggaaaaaaacccttaattttttaaatgaaactcgagtctttggatgtatgtatacctgtaacatagttcatatcatcatgcacgtatcatttggtattacgcgttttccttaaaatcacctcattattttaatatttcaaacgaatttttcaaacttgaaattttttttattattctttaggttctgggatacacgtgcagaacgtgcaggtttgctacattggtatacatatgccatggtggtttgctgcacccatcagcccatcatctaggttttaagtcccacatgcattaggagtttgtcctaatgctatgcctccccttgcctcccacctactgacaggccccggtgtgtgatgctcccctccctgtgtccacgtgctctcactgttcaactgtcacttatgagtgagaacatgcagtgtttctttttctgttcctctgttagtttgctgagaatgatggtttccagcttcatccatgtccctgcaaaggacatcaactcatcttttttatggctgcatagtagtccatggtgtatatatgccacattttctttacccagtctatcactgagggacatttgggttggttccaagtgtttgctacctaataattcaacacacatacatatatatatatatatatatatatatatataaaacaacatatatatatgtgttgaattattatgtagcaaagacttgcttatatatataaaaccttattttacatatatttcatatatacgcaaaaccttattttacatatatttcatatatacgcaaaaccttattttacatatatttcatatatacgtaaaaccttattttacatatatttcatatatacgtaaaaccttattttatatatatttcatatatgtaaaatcttattttatatatatttagatataatcttattttatttatatttcaaatatataaaatcttatttacatttcatatatatataaaatcttatttacatttcatatatatataaaatcttattttatatatttttatatatattttatatatataaaatcttattttatatatattttatatatattttatatatataaaatcatattttatatatataaaatcttattttatatatattttatatattttatatataaaatcttattttatatatatttttatatataaaaaatcatattttatatatattttatatattttatatatatgaaatcttattttatatatattttatatatattttatatatatataaaatcttattttatatatattttatatatatataaaatcttattttatatatattttatatatatataaaatcttattttatatatattttatatatatataaaatcttattttatatatattttatatatatataaaatcttattttatatatattttatatatatataaaatcttatttatacagccatttttctaaataaaaaatacagccatttttctaaaatataattttttcttttaaactttttttccttttcccagggggcaatgcttcactgatataaataatgatgttataaatatttcctttttttttttttttttgagattgagtcttgctttgtcacccaggctggagtgtaatggtgtgatctcagctgactgaaacctctgcctcctgggttcacgtgattctcctgcctcagcttcccgagtagcgggattataggcgtttgccaccatgcccagctcatttttgtatttttcaccgcgttcatccagctggtctcaaactcctgacctcaggtgatccaccctccttggcctcccaaagtgctgggattacagatgtgagccactgccccggccattattttcataatttagctttcttcttttaaaatgtttctttaggataattcatcatatgtgaaactaaaaagtgaaaggaaaactattttgaacttcttgggctctactgtcttagtgatctttaaaaagataacataaatttataaatattccagacttatatgtgaatatggcagtttcaagcaaaattcactaccattgaataataaagcttattttagaatcatttagattttgataagagttaaataatacctaaaagtggttttcatttttattttttattattaatgtaagagagagatttcactgtaattgtctgtcatacattgttcttcttgggttattatctattcatattcactgcttatacatccccacaggtttcttttacctaagcatgtgaatcagctctttatgtttaatacatatttaccatctgtcttttcatacttgacatgcattcgttttcctaagatttttccctatttagtttttttatcatattctttcttttttctttctttctttttgtttttgagatggagtttcgctcttgttgcccaggctggagtgcaatggcgtgatcttggctcaccacaacctccgcctcctgggttcatgtgattctcctgcctcagactccggagtaactgggattacaagcatgcaccaccacgcccggctaattttgtattttcagtagagacagggtttctccatgttggtcaggctggtcttgaactcccgacctcaggtaatccacctgccttggcctcccaaagtgctgggattacaggcgtgagccaccgtgcccggcccatcatattcttaaggccaactttatcttcaacatttggaataaataataagcttgtgatcctccttattatataaaataataactttgatttttgtaacagcagttgaatgtgtatataaaatgaaaattaaattaagattatttgtgaaactaacagctttatgcttaaggaacccgtctgtaagacagattttagtaagaaatggaaatatttatattgtgcctgatgtcactgatattcatccttggtagcaaagaagaaagagcatcaacttttgaatctgaaatctagatttgagtattgactgtgacatcatttagctgtgtgatcttaggcaaatattttaacttatttgaattgaactttctttagatatgtaaaatatgatcacaatataaatttaaagaattattgcgagaattaaaaataatttttgtaaattgcctggtacacagaaaaccatcaatatatgaatccctgttattttaaaatatcactttttttttaaatatgagcttttcttattttgttctcacggaatcttcatgaggtacaagtagtattttctccattttacaggttagggaactgaaatgtgtaagtaactagtcaagttactcaactagggagcaggggagctggaatttgaacacaggcagtctactcccagaagattagctcttacccactgcataaaacggctaatcactgcataaaacatctgtaatctcagttctatggtttttctataagtatttttacctggtcagtgcaaatgccaacctcccattatatgctgtgtgaatcttacttagtcttcaagattaatcagatttctagcatctccatgaagatttatttttgatagacttttttcacatagaagtaattttggcctcgcctatattttcatagtaattatctatagcattttcatactacttaaggtgctagtaattatctatagtactttcatactacttaaggtgctcaaattacattatgcctatttggggatatgttttaaatcataagattccggagcacaaaaagaactatatcttattttttgtatcctttccccacatctagttcaatgaagtgcatatagtagatacccagccaatatttgctatataatcaagggaagataataaaaggcattagattaaagccaaaaatgttccatgaaaagttatgaaaggagaataggtgaaatatgtcaaattatactttgaataaaaccagtattttaaacaaaatatgcttaattatatgaaaaaaccccattgctggttcaaactacaaagcatttagtgtatttcatatgtacttgtgaacatatatgtttttcactcatggaaaatttagcagaaatccctattttttgattatcgaaaaaaaccaaaccaaattattgctgatacaataaagcattcatctcatcatacacacacagacacacaaatatatatcacacacatgcatgcacacacacacacagagtacacacataacaatcaatagaaacaattctggaaaaaacattaaaataagcctttttttttctttacctttcgtcctaaagaaagcagcactgatttatccacttctctctctttacaattgaaacctaaaatctttatctcatagtatttcagcatctggtacatgaagaaaggaaatgacacattcctgcgttgaaaatctttcttaatgtgtttcaatagcactctcatcaatgcacaggtttgcaaaatctaaattt

SEQ ID NO: 985 - DNA, 84914 bp, Homo sapiens; identical to SEQ ID NO: 984

SEQ ID NO: 986 - DNA, 53475 bp, Homo sapiens
ttacatctttaaaggactttatgatttcacagagcatcttcacacacacaatatcttacttgatcctcacaacaaccctgtgaggtaggtgttaacatgttcattatacaagagtgggaataaaaatgctgagatacacagaggcataccatctagagttctactagaatcttaatagtatgaatcttgggtctgtgtgttaaaacgtaaaggaaagaagagttgtgaaaatgtagtctgttgatcagtagagagaaaccaaaaatataacatgtaatcccataagagatttttagaacaaaagaatattggtattctttttcatgatcaaaatatttttgtttgaaatgaccaggtaatacatgaaaagttttatttttggtttaaatgggttggataaattgcccaagctcgactacacttcaaaacttaaaaaaaaaaaaaaaaaaaaaaaaaaaatatatatatatatatatatatatatatatatatatatatatatatatatgctgtaatttggaaaataagaagatgagaaggtaaaataagaatcaatttttaaaaaatattctaaggaattaaaatttttttatctcctctgcatacctatccagccctgttcctcccccagtatagcttagatgtattgtaattgcttgttcatttgtctacatctcttagggacaattagctctgtaaaaccagagacaattatctcttattagctgttatgtccagctcatggaggtacataatggacatgtgaattaatgattgaatgaatggattttcttctatgacatccctatctctggttgagaataatgtttgaatataaagaactctcatattatcaatactcatgacagttctcctagaacccaataaattaaattgtgttctagactctaggtgaatgcgtgtagtccagcctgtgcaatagaacaaggctctgtctcttaaaacaagaaaaagaaaaaaaaaaagcccttgactcagtctttactttgatcaaaaatgctttggaaagagaccagtattcattgaagattgagctgattcctcagtaaaaatcaaatgaaaaacaaatggatttttcctatcattgtatgagttttagatgggatacttaaaatttacaccctagttgtagtctcattgcgcatgagcaaagcatggcgagaaatactaccaaaccacatattggtaattgagatatttaggacagagcctcacacaagtgttatattgtatggtaggaatcgctttgcttgactgaaacatcactcttccaagttagggtgagaacacagcagttctcctagaacccaataaattaaattgggttcaagactctaggtcaatgggtggcagagaactgaggactggttggagcagccctccagtccgtgcatgagaggtgtccaggctgggggtgataggggagagaggtgatggtggagtaattggagtaagaagaggtatgagcatgggagcagaggcccaaacagcaccagggaccaggagagaaggccatgtggaagtcaggtacaacacgggaaccaaagtcatttggaggagtcacaaaaggatcttggaagtcagttgtgcagatgacttgtccagaggtgaagggccttttaatgagatggtagcagaggatgtcccgcccaacccacctgatcttaagagggccctgccctaatatgatcagtgagttgtactggtcctgacacatatataaaggaggaaattaattatttttaacatattttcagaaagccttacaaaattttaaagatgcatatgaaaacattcaatataaattttcacataccaccattaactacagatgtggggaatcaggcactttcatacagaataaattggtacaagcttttagcagccatttacaataattcatcaaatggtaaaatgtatgtaacctttgaaccattgattctacttctagcaaattccctattaaaaagtattcccacaagattacatgtgagagtgttgaatgtagcattgtttattaaagtctgaccaaagcaaacaaaaatcatttagtgttcaggactagaggagtgaatggctatattatggtgattatggtgtagctgaataatagaataatgtgtagccattgagagaaaagaggtagtgacatatataatgatatggacagatgactgacatattaacataagcgaaaagcagaatataccacattagatgtttatgtatatcattctttgtttttaaagcattatgcagttgttatatactctgcatgaggagggagggcatggtggagaatgcagaggctgtatacaaacatctctcttactccttcctcaaagaaagcatgtgcataaactccaaaatagccatgaaaatactgtaactgaaaacatttctgaacatatctgaagaaaatgttcaaagcatttgataaccttaggtaatggaagacagtggggtgctgtttgcagtgtaaaaataaaaaaaaaatagtttcttatttgcaaaacttgactaaagtcaatgttaagaagctcagagaaagcctcaggaaaaggagataaaaacaaaagataaaataaaggcagagataaagataacataaggataagaaggagaactttttaagaggaactcagctgaaagtaaatggagtgaaaaggagaaagaaagaagtaagtcgagtaaaaagtacacagcaggtgggccaggcttggtggctcatgcctgtaatcccagcactttgggaggctgaggtgggcagatcatgaggtcaggggatcgagaccagcctggtcaaaatggtgaaaccccgtatctactaaataacaaaaattagctgggtgtggtggcatgtgcctgtaatcccagctactcaggaggctgaggtgggagaagaatcatttcaacccgggaggtggaggttgcagtgagccgagatggtgccactgcactccatcctggcgacagagcgagactccatctcaaaacaaacaaacaaacaaacaaaaaaacaaaaaagtatacagcattcaaaagtgaccacattaaagaacgaatggatagaatggagaaaagacagacagattaatgtttctattgttttaatataacagtaatactcattaagtaacactaaagtactccgaagacacacaatactctgttgtactttgaaagcatcatgattacactaatgactactctaatggctggtattcacaaccatgccctactttgtctaaatatgtcatacctacacaatattaggttaaaataattaggttttgtagggcagataaattgctactgtatatttctagataatgattacaaataaaaactgccagattttggtacataaaaggatttgccattatctgcctaaaacagacccctgatgattaaatatgatcaccctgtttgtgttacctatcccatggacacacagacacacacacacatcacatgtagtttctactgggaatacagagggagggaggagccttctgattctgagaagttaagtggggattccacactcctcttcataatcctttcattatatcagtatacattcagcctagacacaacaattgacttacagcatggcaaatagaagacatctcatctaatatttagtatttaaggtccaattaacaggttgtgtatattgcaacatgaggtcggcagtagattgacaaatattcttgttgtgaaatctattctgttgtaggtttaaaggtttagaacatggaataccacatttcaagtttttagaaaaataaacgaagagccccagacatcagatagttaatttttcagggttcttaaactgtccaaattcttatatttaaggtttcatttagtaaggaaggaggttgtaattgtttctatgcataagcttgattttcccttagtggatagaaattgacttgaaaattgaacaattttctttgtggaatttttagaaaatagtattcatcacaaaaacaaaagacaaatggataatgagattgaaagagttgtataatataatctatttgttttaccccaattagcatgcttatttgtagaaaattatgtttggcttccatagagtctgtatggatctgtgctgaagttgcgaacatttgcctcaagcccagatctctagtatcacagacttacttattacaagaattcacacagaaaacaaaatactatatacttacttaatgtgtttccactccccttttcccctttctggccttttggtccagaatttccttgagaaaagaagaaaaatatttgtttttaatcagggcaattcacaatgtttgctttaactggagacagatcatcacaaggtaattaaaatataatagaatggacagatattgaaatgtataataacattgtataatgttaacaataataatagttattacttaggaagctccattctgaactcaatattgtgatatttcaaattatttacaaggccctaaatgccccattttcctaaatcaagcaaagctgaagaataaggagtttgttttgtacttatttatcctccttttctcctcttcctttgactgggtcttactcacacccccaggaagtccagtgccttccatgagctcccacatcccgttcttatattcacattacatttatggttttcatttctttagagtgtaccatccccaaaaactgggctgccaatgactttctgggagtgttgagattcttactcatggggaaggtaggaagatccttggagcgttcacatctccaggatgatcacctttggttttgagaaacctcacccatttatacaggggtgtggtacaaatatttcatatgagggtcagggcttcaaatggatgcagaaacattgctagatctttttttttgccaacggattgctacttcacccactgtcccatttttaaaggggtgtgcaggagatctttctttagtaccaagaaatctcttaagattggtgctgttcctgcttattgagttttttttccaacagccatgagatacaatcagatcttcaagtaattactaccttgacataaatctagaactgatcctagtgctctctgtctcaaagtcaaaacctttgttaatgtttttgattccctccagcaaaactgagaaccttcaaccttttcatcctagagctcagaggatgtagtttaacaaccatagacttcaaaataataatagtaataatttagaaacccctgtgttgagttattttgctctgctacttactgggtatgtgacttgggacaagtctttaaatctttctgagctaaagtttattcttctataaaataaaaaaataacgcttttcattgtagagttgcctgttcattaagcactttgcccataaaagatacacataaaagatctagttcttcttattcctattcttcacctcctaaagcttagctggaatcttctctttgtgattttattctcagagaatgagagaaaaactttttcatcgcagttcattttatatggtacaattatatataattttagtgtttatatttatttttgatttctctagtttacattgtcttcatctgtgctttattttgaacatgtgtcattatgtatttcttagagaagattttggatcctaatttaccagctaaaaaaatacatatatataatgtaacatatacaatcagtagcatgagacttgaggcacttaaagagtaaacattattcccaattgaaattgtattttgaagatttaatgaaatgccaaccattttatatcaggtcataatatcaaatttctaattctctaattgctttgcataatgtgattatactttatatcattaaattcatttcttaattgtaattgagttgtttcaggtactgctaaattggcaaaaattgttgctaccacaaagcacccaaaacctttcctatattttgagagcatgctttaataaaatatagtgccaaattttcagattgtccaagaggaaaaagctctaagaaattgttaaaaattagggaagggaggagttaaaacaaagttctaactcttttcataaaagagaacataataagcaagcttaatttcattatttcaacattaacttcacaatgagaaaagagaaagaaactatgcattgttcttagaagtcttttcacacagcaacttgtcttagatatttcagaatagacatgcttaagccagagacatgcttgacccacgaaaggtccttgtagctctcagattctatgataaataaaaaattagtttcatgtttttattttgcctttgttcttataccactgtgacttttccttttaaagatggtaaaataaaatgccttatctccttataaaaaaacaaacaaatgttttgtatcattttaacatgattcagagatttgcttaccgatgatacttgaaaatcttttctcacacttgaaaacagcaaaaatatcctttctaatggagaggaatgtagtggtccttcagaatgatacctttggttaaaaatgaatgcaagggcttggtccaaacctagagttaactatctcctatcctatgtattactctttaataaaaagtaacttatatttctaaaagccattcaaaagtaagaaccaggtcatatgtaggaggatattctaacttgaaaggatgtaagagggggtgtcttcaataacatcatcatgatttcaagcattttttgtgagcctcttatatgagccggatactaggttagacatttctgcttacatgccttaattacactaaccaaatttctgcagctgtaggccgcctttccatcccccgtttctttcaagctactttcaaatgtgatcatcctctctcctaagccttgtgcttcttcctggtccctgaattcctcaccttataaccactcattaaccttacactatcttttttgctttgctttcctctgtcttcagccactcctcctctattttatctttccataagcatttaagtggtactcagatccttccttcaaagaaaaaaaaaaccatatgaaacaaacaaaactaacaaaaaatgcatctcttcctcctcctctgcatagtgaggcagcttgagagttgagtctaccacatctccaacccttatcaaccattcccttctccgcataccctaatctggttatcaccccaccccacagaatctgctctgaacaatggcaacatccccacagcagcaggtgcaaagggctttttgtagacttcaccttacttgaccacctttgaaactctgtgtttgccttttttcatgctctgttctctgggttttcttcttcagttgggctacttctcttccatttgctactttgttcatctcagcctgtacttctggaactacttaaagctttatgctatgccccttctctttgtacctttccactctctacccataaaatattattaaaatcagtggttctgaataatatttatataatcatagataaactttgtcttttaatctctggcctctactcgaaacttcagactcatgtgttcaaccgtctgtagatagctccatgaatcacagagagaaaatgttcagtaaacgtgttgaattaataaatgaactacatatggtgtaatattttagataatcctgaaaatgaccataacttaccctgagggaaacaataagtctttgaatggacttcaagaggcaaaacagacagaagtacgttatttgcatgctgaaagttctactatgttgaacaaggtagaacagaaccttctacggattttgaagacgggcaaggtttcacatcaattaaatcctccaaactttctgaagtaaatatatcaggtcttataaatggactactctatagatctgctatgcatggagaaagtgtgaagtcttctctttctcttctcatgtttgtgtatcttttcagttgtagactgtcttattcacccttcatttccctgtttctagcactgtacccttacgagcagtgtgtacttaatccatgtagaaggaaagggcaaggtgagaagaaaaggagtgtgggagggagaatagaagaaaatagatggaggatgttctttttgaactttttgcttcagaatctgataatgtttttgatatcattcacatagtccaggctgtgaaaaaattacaactcaagcaatgtaaagtatcaaagagtgtttatatcacaaattggggtcttagctctgaaatatattactttatctatcacggacctgtttttacttatttcatatttgacaattatcggacttatttctaattttagcaccttcttcagactcttgtagaggagagactgtactgttccttcttttagtctgcagtacaactagaacagcacctggcactgctgctgacatctctaccagattggtgtcttttaataagaagtgatgtcctaaggatatgttttgtcaagggacttattacctctgccgttgtttttctttgtgcgtgattactctttctgcactgtttttttccacctaaacataatggttttcaaaatgtggtccctggaccaatagcatcaccgtcacctggacattggtgaggatgcaagcccaatcccagacctactgcatcagaaactctggggtggagtcctgtaagctgttttaacacatcctcctggtgattccaacacctacaatagttttagaaatacaaacctaaagaaattctaggcctcttttagtccagcgctaacaaacactactttctatctaacacattttcttacagtatggaattaatcactccttactctctacttccatacagcaatttgtccaacctcaccaaggttgtttacttaccacatggcattatagctaattgcttatgcattttttttctgtatccagctccttaagaaaagcagctgtgctgtatttatctccagcacacagtgacccctcatcaagttgtgtgaactgggtgaatgaatgaaataatactctccaaagctaaacataggtttaccatttgatccaacaatcacactcttaggtaaactcctgtccacagaaaagccagcacattaatgtttatagctgctttacgtagaatttctaaaacttttttttttgagtcagggtctcactgttacccaggctggagtgcagtggcatgatcttggttcattgcaacctctgcctcctgggttcaagtgatcctcccacctcagcctcctgaataggatgccaccatgcctggctaatttttgtatcttttggtagagacacggtttcaccaggttggccaggctggtcttgaactgatgacctcaagtgatccgcccacctcagtgatctgcctgccttggcctccaaaagtgctacgattacaggtgtgagccaccacgcccagcctaaaactttgaagcaaccaaagcgtccttcagtagttgaatggataaacaaattgtggtaaatccataaaatggaatactattgagtaataaaaagaaatgagcaatcagaccatggaaagatatagagaaaccttacattcatattgctaagtgaaagaagccagtctgacaaggccacatactgtctgactccaactatatgacattctggaaaaggcaaaactatggagtcagtaaaaagatcagcagctgccaagagattgtggtggggaggaatagagttggtggagcacaggggacctttagggcagtgaaactattctgtctaatactgtaatgatggatacatgacattatacatctgctgaaacacataaaatgtacaacagaaagagtggccactaatgtacattatagattttgggtaataatatgtcagtgttggtttattaatggttacatatataccacactaatgcaagatgttaatagtagaggagaccatgtgtgcatgggtggtttatgggaactctctatgctttctgtgcagtttttctataaatgtaaaactgttctaaaaataaaatgtagtttaaaaatacctcaatgatagggaccctattccttttttttctttttcttatttttttagagacagggcctcactatgttgctcaggctcgtctcaaactcctgagctaagcaatcctcccacctcagcgtctcaaatagctgggactacaggtactcacctctgcacttggcccgactctattctcttgatgataattcactttgaaatgaggagacagtaagcctagctctttctaagattgctgttcaaagtttgcaatttaagcttaggctactggcagagctgatggaaataatatcatcatgtgtgtacatttcaaaatgctgagcaaccttgattcttaagcactagtagataatggcagacaatttattttgcagaggataggatttcagacttctctgtattttgctaacagtaacttcacaaagtctggccagttgtggttaaacgggtatttacactttgcttctttttttttctttgccagtctttcaactctctttgttcaaagacggatatcattgttagtgatgatttatgattgtgaggagtttataactcctgtgtgtttttttaaacgattttcctttgggatatagagactttcctcgggtgaacagaagtcagtttcaaaaatctgatttcagaaatcatttctagaccacaaaataactgcatgtgaatactagtattcacacaatgaccactttttatcatccaagaatttaaaaatatgtatactacatatataacattatgtgtgtgtgtatgtgtgtgtgtgtatatatatatatatatatatatatatatataaaattatctggtgtttcttctacatattctataaagaaaatacacattattgtaatacctggccttccggcatatcctgggagtcctcgacttccaggaaagccaattgctccccgatcacctttaagacccggaggacctacattattaacgaagaaaaaaagaaggtaataattcattttcatacagacttgagagtataatgaaaacatctagttttataagtgaatatgaaattagagaatcttcaaatgaaggaataatatctttcctaaaatttaatgtttgacattgaaaaacaatagaagcgataaatataaaccttagtacattcagcacattgtagctattcaataaataacatattgttggtagaaataaaagcacattaggaaaaatagatcttggagttttaaccaaaagacttatgtagtcaaccagtaatcatcaaatggcaggatcttgctgtagctgaaataataactttaaaatgcataagctgaaaattgaattcttaagatttgccttagaaaaaaatgcaactcaagcaatgtaaagtatcaacgagtgttttataaaataaattggtgtcttggctctgaaatatattactttatctatcatggacctgttcttacatatttcattgtaatcccagggtaaataaacataaacataaacacacacacacacacacacacacacacacacacatgcgatacacagatttacttatgagtatgtactatatacttacacaaatccagggtttcatatgcttaaatgaaaactgaaaatggctattttttttacccaatattactatggtgatcataacaactgtatataaaagaaaatgttatattccagtgaaataaaatattttatcctagagttcagtagttcttgataaactattgtaacagtttaggcatcttattttgtcattatcaattcagagagaactcgttcacccagtctcacttgatcccatggcagagaatgccatgttgcctgctttagacaggagcatcttggggccataagagcatcagagaagcccctccaatgctgacttctcaagtacctcacagtgatgctcagaacacagctgttcaactaaaaatcaaggatgttcaactacaaatcaagtacattttcaatgaatgaacaaataactctgtaaatgaagcatatgagatactttcatagaaatcaggcagtcatagacctctgttcttggagatggttaagcagactctatatggcctatggagttatgtgacttgtttgtttaatgatggttcaaaatgtagtccccaaaatgtaagcacagctgttgaactttattccataagatcagataccctgaggctttcaggaggcaattaactaattttctacaataatctgtggcaatgggaaagggtctggcacctgcttctaactcatggacaatataagtacagttacatggaatctcagccatgggatgttcaaagagacgttagacatcatcaagtcagaatccatcattttagagacagttccatgagaccagagtgatcaaatcacttacataaagctggtctgataattattcacatgtcctaggtgtcctgctccattcaggctccttcctgcaaagtagcagactggttaagggcatggactctgcactcatgcccattggggttcaaataccagctttgccacttaccagttgctgattgacctcaagcaagtcatttaactttactgtgcattgcacctgtaaaatgggtgtattatttgtttctgcatcatcaggctgatgtgatagttaaaagagctcatacacgtaaaacacttagaaaagtgcctggcatgtaatgactactttgtaaatgttagcttttcttgttctcctccccctcttcctcatcctcctcctcagtaatacaatcattatttttaccagcctgttgtaaaggcttctaaatttagttttattaaatgatacgtacacagttagcagtgacattttttgattcactggcacaatttgttacttccagaaaaaacccactttcaatactcaggtgtagagcgacagcctgcagccaggcaacattccttactcaggtgtatatttaaggatcctgtccttgctgaagctttagggaggggccttcttggggccatagcctatgggaaggggcgggccagggtaaagatatacgtggatataaacattaataaaatatggttcctctcttccaatatctatgggtaagatgagctttattttctcttctggaagcacgattcctatggtggaaaattcagactacgtaaggaagtaaatagtactggttgatgatgaaaagtttgcagccagagaagccttcagttctctcgagggcatctcatgtaggtagccccacccatgcctacaggtcaaactaccttgttattgatcacattgggcataaacagcttcttagatggcccacacaaagtttcctttagaaaagaaagttgcttctccttcaaaacattgttgtcatgggtaaaatcagccccttaaaagaaactcacatgagataaaaaatccttgatcatgacatttgcctcccttatattactacttatcatcctggaagcgctgtgaattcagagattctgtatctgtttacacatactctatagggtattgtagaacaccaggcctggagaaagtgctcagcacatagtttttgagtgaaaagtgataggtcattctccctagcatgctttcaaggaaatagccctctaaaataaatttgttattatttggggaataaagcatatttaaacataatatccaccctagtatatgaataataattctactatatttaatgtattagttatttgaggctactaggacaaccacttaggttttgcagatattcgcatcatgattgtgagtctaggtgagtttgacttggtcaagctgagtttagtaggctcaaatggatgtagagatggggaagcaataaacctgctcagattagaaagcagaattagtatgattgtccatcatatactctttgcttcctgatttcggcatcaaatataaggcaattagacaatctggtggagaaacgaacagaatgcagcaagacatccagaaataattcattaggaaagatgcctggtattttgaatacttttcttgtagtgcaccaaacaaaatggtaacctgataacctagaagagtcattgattaccccaggaactcgacctgtcttttatgaggaactgggtaatgcctatttgtgtaaatgagcagtaccaaaagcaacaaattatgacatcactttttaccctgtaaatttaaaccatgacaaatcgttaatttacaataaaaaaaaaacaaaatcaaagattctttgcaatggtgtctatttataacattaacacaagctgaaatttataaatccttctatttcatacattcacagttcagaaacagctgcagaagattctcccaagatgaagcactgtatggcaagatgtagcccagactgaatttttatggttgagttataaagctctgacaattgcagcctgtatggagggggtgatagacccttgacaatggtagttctggcagcagatttaatactggttatttcctctgcttatgacattaatgcagcattgttaatatctgattagcattagtcaagtagaaagactttcctgaataaaaattctttcctggcaaggcattcaaaagcacatcaatactaataccacctgacttggcatattatatatatgggtaggattgctattttatatatataaaacatgtgtacctggatgtatatcatctatcttcacatataatatgccatatatatttatatacatatatatacatatatgtgcttaggcaggtatcaagttcatgcttctcattttcaaaaatttttctgatgtgaccagggctagtcaatacactgatcagaaagaagaaccttttatataatcaaaagacagaaaaataagatgaagtacatggtatttagacatgttttggtaacacaaaccattctacttataattagaccttgcagtatacttcctaccatcaaacggcatgcaggatatttgatttcaagccaaggctaacatgacaatcatgttattatcttttttattttttcaagcaaagaaagttcatgttctctcttctgtgtcttctttcaaaatatttctttcaagattacaacttagaggaaaataatttgaaacagttttgctcttagtaaagcacagagagtgactgtcagcaaggtaagtgtcatccatattttagccaatatttacattcagatttcattagtttaaacagatatattccaaatactatataagaaatatagtccaatttgcttgtgattcataactcactactagtgtgagtttttatgtcttaaaaatgagatagcttgcaaatgtgaagatgatttattcaacgcaaagataattgttgtactccccttcacatatgatctacggttaggtctgccttatactgtttgctgtctattatatacatgtcactatctagacttacaaacaattccatttggttactctggttaaagcatttattttcttcaacagtcatgagtaatgcttatcattcagtgtattatgtgattaggctactagaacatttactaatcccccaaaacacacacacatatacacacatgtgcgtgcatacacacacacacacacatacacatcctctgcaggatataaataaaatagcaatcctcccctacacatgtacctggatgtatatcatctatcttcacagtatatgattaaatagctaaaattaccatacctattggacctggaaatcctcgtggaccactttctccagtgggacctcgatctcctttttcacccgggggtccaggaggacctttaaaaaaattacagttactgatcatagttgtaaagcataggaaaaatgggttagtcatctgtcaaggtacttatataaggaaatccaaagtcttctatttgttgtgcaataatatagaatgtataatactgaacttcatgaatggaggagtattctgctattcaggaatataatgccctatactaatgaggatgacattgcctcaaagtaaacaacctaacagtatattaaatgtgagtgtgcctaacacttttctatgttctgagaacctgggggcagagaaaagacagcaggctggcacaaagtcacattagtgttgtacgcatcctaggcagttagacatagagttagatataatacagaattagctactatacggaaaatctataagtaagaacttaaaagacatttgtgataccctcaagggaaaggaaaattcacacatggtagacaaccagaaagcactttgttggaactgaccataaactcagatatttgtcagtgaactgtagatcggcgtgaatggtgatggttgaagtcttcattgagaaagtaggatatgaggggtactttcaagaatgaagggaaggggaaggaagacaattcctagggattgagaaaggcatgaggaaaggcaggaaggtgaaaatgagtagaggaattcttttttcaagtaaaatattaagtagaatttctaggttgctataaatactgtaaacaaaatggagacattgcaaggaaaactttggtctcatcattttttttcaggtggctctcctgagagctgtaactaaacaaccctgatttagccatttgtattttctgtgtccagcaaaacagatacctgctcatcatgcctttaaaatgattatacctagcatgtctttagaactcaaaggtaatcctacctaaacaccatgttccatatggagtacagaggacaaataatctcttctttatctaaagaagagcacttagtttccttttcaacaccagaagaaagaaacagaaagaaacattattccatagattcaccacagaataaggaaatagtgatattttaaaggaagcattttcaattgctagtttggacacatacatagtccaaggaaaacaaatatatacagcatccctggttagaatgcacttgtttacaaattttaatcaggtgggagacataatacccgaagaaatctaagagggggaaccacataaataaataaagattatctcatgaataagtatattttgtacattttgttgttgcttattttgacatccttgactctacttctgtctattcctctggtatgtcccattttcaaggtacaatttgggttttagaggcccaagatatcattattactcttctcaatagaatgtccctttctcctcatatgcaacattggacacacatttaattgtatttttattataaaagcaactctacttataggaaacataaaagcctagaaaaagcgtgaggaagaatataattcgtagttgtgttattttaactaaagatctttaccatttctttcctaagtgtgtacgtgtattttttttttccacataatcgtcatgcaaacaacatgttacagggcttttagaaattaactggtgtattatattctaaggtatagcttaattgctgcgagacatatatttaaatgctgcacaagaaatgtaagatttctgtatcaaagggaatctctatgtgccccctattccctgcagaagaatgtagtacttcccaagaaaatggagttatggtaacttccataaccatgaacgcagctgcatccattcaacactacatagcaatgaatcccaggggaggggggcaagcaggacagacactcaatttatgcctgaattttgttgagctaattgaagggaagcacagggatagtaatcaaggatggtattttgaaaaaagtgcgcaagcaaagatttcagtttagtaactcaggatccaaagcaagacgcagacattccaggaaaaactagaacatgaaacaagaagaaacaagggacacagagaatagatctagactcttagcctctgagatggacttctcaccatttctttggtaagtaagagatggaaggaactctcctaattactaactatcctttcaattatattacatgtaattatgggaactgtatacttaattttggagtattagttcaatcacagcgaatagatcagtattattttacaaaatttggagttaaagatccctctctgtatttttatataaaaatactgatacctggtattcgaatcctacaataagaaaaacaggtaaagatttttgttagagttctaactaggcatgttgaatgtacctttttattgtcattctattcttcatgtaacattaatctcacattatgtttcatttttgtacattgttatagatcttttactgtttctaacaaaatgttggaaggatctcaataaatgttttaagtgtcttttagattcattgggggaataaaataacaaattatataccactttactcttagtttctgatgcagaacttttaagaacactatccactaccttgccaccttccaaaactagcctcctctccattcccattgtagctcacgtcttcaccatcacacagctggactattgctagagatttttaatctagtctgaatgtgttttatctgtttcacctcctagttccctcagtgttggctttcttcttctttttgataagaatccgttttgcaatgtctctatcaaattaaggaaatgcagtaacctattctgtcatattatggaaaaaagaataaagacttagagtctcttgtagtcaccttttgttcgtagtttccatttagtcttttcaaaattttgttccatactgacataataactgcctcgttgcatcaataaatggacaaaatgctacctgtcagctcccttgctgatacatgtcaaaaaaaatgggttaatattggccaaaatatatgatttattctagttcaagaagccatagaatttacattatttttcatctttaatatttccaattacagttacaggaataattcataaatactatcacaataatctgccatgaagaattacctttatacaacacatgcacaaaatctactatgtagcttcctccatgattacttcttaaaaaggaaaagtaatatttctatataaccacaaaaaagtactgatatataatatttgataatcatcaatatcatagaacaaaattacacaatttactagaaaaacaaacccaggtgtatcatatcatttaaaatcctcagacgataacatagcactaataatatctgactaagtttccagagcgatgcttctctagtttttattcattatgagcattaatcttctactccgttttcaatcttgtctcatattcagatcatcataaaaatctgccacatcttctagtctattgctgcctaaacctgcttcttttttttttctctagttttcatgctcattgatttagatatgtttaatctggaagacactttaaacattgtttaactaaacatatttatagagggtcagagagtgagttgctcaaggtcttaaagctagttgggttaaatcagaactagaagaatttcatttctttcctgatcctatgctaccatgttctaaatttaattgacttcattttccacatctgttcttccattattcctcagctgaatttttcctttacatagtggttagacaaactcacaattcagtttttttcctttggttaatttttttttttttttttttttcagagatagggtcttgctactttgcctaggctggtcttgaacttctgggctcaaaaggccctcatgtctcactctcctgaagtgctggaattatattgtctcagcctcccaaagcgctgggattacaggcatgagccaccacttctagcctacagtccagctgttacaatctcagtaattaattatacaaaactccaaattcaaatgccctcagttgctttttcattttctctactataaaaatcaatatttcttttttggtgctttcatatcctaggaagccaatatatctaaaatgtttccaaataaacaaaatgttagctattctcaccacagagtcatattatattttatttctcttaaatacctttctctagagttcatctttgcttctttaaatcacgttatccccaactctccaccaaactctacttcaccatttccacaatgaaattttatgtagttctttaaggctctaattattataactatttgagaaatgtattaaaaaatctttgtctcttttaactgtataattatttagtgattattaatataagggaaaagagaacacaaagtaattacactaactctgcaatcaacacatgataaaggataaagcactcattaatttctaaaatatggttcttaagttataatttaattaatagatattttatggctaggtgctataagagatataaagaacagtttctaatggaagtagcttgtgtccaggaagagtgaacactgttctcgaagagaatatgagatacttttatacataactatcacattaagtattctcttgtgagagaatacttaatgttccatattaagacagaaataagtatcagctgggccttactattggtagaaccagcaaaggcttcatgcaagaggtggcatcttagatggactttgaatgataaacaagatatcttcgaatacaaatcaaagagaaaatatttcaaataaaggaaaagacatgaggcaggatgcacaaagtactgggtacattagaatcacagtcaaattagttgaaatatttgatatacaaaaaagacaagcgagggaatgaagcattcaagactagttaagagacacactgaaaaagaccttgagtgctacaggcaaaactgtatgtctaatgacggggcaacagagagtctttatgcaatctaagacttcctttaggaaggctgtattctacaagggtgcaaaaaggattacagtctgggcaggaaacaattgcaactctggcaaagagtcataagaataatttatacgaggatataaagaaatgacaaaggaacagagaatacagaatgttgagaactaatggtggtcttgggagatataaaataattaaaattgatagcttggaaaccaggaagaatgacactgctattatagagtgtaacttgctaagacaaaagtcttagtttcacttattcactcaacacatatgtaattgctcacccactattttccaggcactctaacaggcattgggattgcagaggtagacaaggaggagaagacttaacctcacagagctcacattctgctggagaagatacaagctaaacaagtaagcaaatgtagagatgacatgatttcatatagtggtaaaaactatgaggaaattaaagcaaatcatggtagagagagatgggggagtttagaataagaatggtggaaagtggaggaggtaacttcaagtggagccaagaaggagtagagacgtagagaagaacctttcaagagaaagagaaaatgtctagtgttcattatggacagcatgaaatgaaacaagcactttttctatattaacttttacttgttcgtggcacttcattcttccacatttccaagctaggcagaaggatgacagagggaagattgagaaaattagggcagagaagtagacaggtgacagaccaagtagaagtttagattttatcccaagactaatgagaagacattggaggatttaagcaagagagagaaaagacacatctagtgtaaagagagaaaccacacacatccagtaatttgtgtgggttttcttaaatagcatttttttttttttttttttgctatttagaatggactaagagcagagccagggacaccaactgagaagcggatgtaatacaccagactgggatatggttgcttgaattagagtagtagtagagagtaagaagaagtttggtttgagatattgtatgaaataagaattagtaggacttacaaatggattacatagagaatgagagcaaggaagtcaaagacagcttccaagatcaggcagtgagcaggtagttggaaaatgacaaaaccaacaaaaagactgaaaacgcaacagatttggggaggcagatgcgggtggctagttaagaagcaaggatttggttttgaatttgtaaagcttcggacatttatttgaaatccaaagtggaggtatctaactgttagagaaaaatctgattaattcaaatttttctttatcatctgttttattgtgataaatactatatatgatatgtgttctgtataagcaagctataaagtacaacaataatgagaatacccttgcaacatcacaatccaagaaatcggtatctacctagatgttcccctatctcattcatctatttccttttcatagataaatattaccctgaattttgtgtttatcattttcttaaattttaaaacaatgattatattacatatttatgtgtctgtaaatttacataattttactaactatgagcattagaagtaaaaattgtctatatatagttttctgggacttgtttttattctttttttcattgtcatcacttgattattaggcttcttaattttctcaaactagtgtatttgaaatgaagtcacatgaagttcttagttctatttttctagttgctaatgatataaaatgagacaaaatattaaaatcatgaaatagagcttaacagacatggaagctggaatgagaacatccaatatgaatttcatgtaagttacagaggaaaggagagaaagaatcgtgaagaagcaatagtcaaagtgaatgaagctggttatattcccaaactgatagacataaatccactaatataagaagtacagcaaatgttagatggataaattatcaatacaaaaccacagataagtaaaactgcagatatgaaagacaaagagaatgacaaacagattggtggcagtcattttaagagccacaagaaaagcttgaagccaggggaccaattttttcagcacactgatagaaggaatcaaaataactgtcaacctaataagtgtgtatatagtaaaacaatttcaaagatcaagtcaaaatagagaaaatgaaatcagaaggtttcttgatcaatttactttcactaaatgaacttccaaaagatatacttcaggcagaaggaaaataatcccagaagaaatgcccgaggtgcttttagaacggagaacaattggtaaattcatgcgcaaatttaaataaatatttgttgtgggtgagcgatgactatctgagccagtggtgcagggttaaataatttaccaagatggttgtagataaagaaaggcagatttattaacaaaagcaggaaaatacgttgcaaggaggcaatgagcaggccagcagaagagaaactgattgccaggaaacaaaggtttgctgaagattttatagaatagtgtttataacgtatgctgaagagagcttgtgcagtactgataaaccaaggttagagtgggttaacttgcaggtatctggtgacaagtttcttgcaggagggacctacatgttctggaccaagaagaaaggcagatttatagcttatcttctttctctttgctttccctggtcctaccagcctgactacttttccctaattaaggctccacaagattgtctgtataaaaaaagaaaaataatattgactaagttctcgattaaaaaaaaataaagtagaataaactgtactaaaatattagcaggaaactagggaagaggatcatcaaagcactttcagttccttgtgtattttaggatgaatgttaagatactgatcaactttagacttcaagataaatgttaaggtcaacaatcaataagaaatagaaatatactacaaagtttctgaaacctgtttggtaattttggtagagagaaaaattcagcaagagaaaaatcttaatcaatccaaaagtggcaatacagcaaagcaaaagaaacataaaataaactggaaaaaaccagagcacatgataagatagtggaaataaatacagtgcaaagagatggtcagattgtatatttttttaaaagaaaaggtaagtattcattacaagagactaacctaaaacaaagaataccaacaggcaaaaggttgcaatcaaaatatagaaaaatacatgcaaatggttgaaatcaaaatatagaaaatcaaaatcaaaatatagaaatcaaaaaatcaaaatatagaaaaaatctataatgtaaagctaaaactaaaatatctaaaatgtaaagctaaaactgaaagcctatatatataaagaaagcatatatacatatattttatttatatatataagtaagatccaattcaccttatttcactaacaggcactgcagaagaaatggacaaatccatcattattttggagagttcaaaagatccttttaattaataatacagtcaagtaagaaataaaaaagactggaagttttggaaaagcaatattaacaagcttggtttgtgaacatgtgaagaaacttgtaattacaaaaaacttgtattcagtacttatgaggtagtttttaacaatgagaaaatcattagaccttaagatatattttgcttttccctttctatttaagtgataccaggctactggttatcgtaccctgtctttatctgattttcatattctttcctttgggtatttgcagtaaatgtaagctcagaaactatttatttcaaaccataggatttcaaatatcaaatctctgcatgtatcagtatattttaatatatatatcattttctggagaaatgacaagacattttaccttgaattaaagtgatatttctcaaggtctgagaatgttcccaatctttcagtctgagatcattagtgatgttattcagtactttcacttctccttttatttcctgttccaaatgcacttgttcttctttcatagccataatttctgctgatacattgtaaacacgctcctctaatttactgatttcctgtaaaacataagtgagcattcacagcctttgttacatacataattatcaaatatgaaagttcaagaaaccctcggagttcaggtttttaaaaacatattatgggagttttatggaataagaatatagaaattagaaaactgttttgaaagtagtaattctttaattgtgaaacatttcctcttttgactgaatggctgaatgtttacaatcacaacccccttcaaaaatcaatttaatgtatctatgatatgtttctattcctatatatatagatgtcaaaattctaacaataaaattaaataaacaccataaggtcttaatttatctgaagtaaaatgtcttcgtactgtacttacagtggcaacatagtcaaatttcgtgaatttgatagatttatattggaaattgttttatagtaataagtgaagtttaatgtcataatcctcagtggtgatgatcattgacaatagattttcatactcaataaaacctcgaactcgcatattaacagtgctttactttcagtttgcattgcctctgtatttgaggcattagtattttgtgttttcaaatacacgtatattttgtgtatatttatacatacacattcatatacttaagagtgtgaaaaagacagaggatctacctatatcctggaatatgcttttatattttactcaataatatattaaggatatttatctattaaaatactttagagactgatattttcagtaatttagtggaattgaatctatttctcaaaatttatttaggattcctattcatagtgttttgagctgtgcacttttctacaactaaacaatgctgccatgaacatcattttaaatatatttgtatattgatataagtacttctatagaacatcttcctgaagtggatttgaccaaagggactaaacattaaacagcatttttgttcaaccattgccgtactactctccaaatatatgctaccatttttcttcctcttactgcgtatcagcgtccactttttgcagctgaatactgggtaccattaatatatttaagtttgcatagtaagagtaggtacatagcaaatcattattacttaacttgtttttcaaattatagtgaggttaaagtatccagtcattaaatttctgacgattaatgtttattaatttttcttttagatcatttgcttggttttctctttcagcattgggctttttatttttgatgaaccaaatgttctcatctattctggtaataatttttgtctctctgttctacttttatcccattttctgtcttcattgtatgctttattattgtattaagtactcctatgttctaaagttgatagatactcatttccgatttgcacatggggaaataagccagtggtatgtttttctttaatccagaagtaaaaagaatattacactctcttgagctggactagactagacaagcttaggtgagaggatcaagatggtcagagtgtaggaccttcgaaaataaatgaatgtgcgtctagatttgcctcttcaatgacactatactgaagcagagagacttaccagcttttattgctctaactgtgccttctcccaaacaaaaccttattctagattagaatttctctatcttgcacctcctcctcccctgaccatttaatattttctgtacaataccatcattacaataaaggtgaaatagtgagcatggatgtttgtagggcacaccgccatgataaatacacttgacttaatttagggggctaaaaattgctgcaagtatgtcgggtagttccagacattcagcataaagtgttaagtgactagacagtgattttgcttcctagaaacgaggaatcatccaggtttttcatcatacctaaaagctgaggctactttttctttcttttttttttttttttttttttttgagacggagtctcgcactgtcacccaggctggagtgcaatggcatgatctcggctccctgcaacctccacctcctgggttcaagtggttctcccgagtagctgggattacaggtgcacactaccacacctgactaatttttttttttttaattttgtagagatggggtttcactatgttggccagactggtctcgaactcctgacctcgtggtccacccacctcggcctcccaaagtgctgggattacaggtgtgaggcactgcgcctggcagctgaggctgccttattattcccttctttgaaaactgcacatggtgtttacatttgtcaaatttcagtggaaattattttcactgggaggaggaaaagtgtatttaatttcaaaaaatcctatatagcatccacacactccctccacatgctaccaccagtgaccctcctagaaacaggcatttaattttgtagtcgtacagtccttttcacctctatggatgatgataaatgccacccctgtctttcatttggtgccaatgttcttcctctttctttcaaattaatttttggtgtgtccttgataagtgttatgctggtgtcacttataacctatttcctcaaacgccatttacaaattcaggcattcatttaatttatttattcctacattgagctaaagattcaaaggtcaataaaattattcaagcaatggggatgagcgtcccaatgttgtttttcagtgtacacaggagtacacacacacacacacacacacacacacacacatgcacgcactggcactgacctagtttctaagtctctgtgagtgactactgtttttaaagatgtatatagctttcaaactttcaccattcccttgcatttccttttctaatgctggaattccctccaaaatttaagtgtaatctatcgaaactcaaacagctcactgatcaccagattttgatcgtttccattaattatcacttcaaacaggttcaaaatttctaccaccttccagatagtttccaatttgctttcaattcctcatgtttgggttcaaaagcattcgatggtcagccaggcgcagtggttcatgcctgtaatcccagcaccttgggaggccaagacgggcagatcacctgaggccaggagttcgagatcagcctggccaacatggtgcaaactctgtctccactaaaaatacagaaattagccgggtgaggtagcacgtacctttgatcccagctacatgggaggctaaggcacgagaatcacttgaacctgggaggcagaggttgcagtgagccatgatctcaccattgcactccagcctgggcaacagagtgagactccatctcaaaaacaaacaaacaaacaaacaaacaaaaacattccatggtctctgcaggatttaatgcactgccagaatcaaatgtatccttcttcttccatctcatccaccttccctctgtccttacctcatctcagtgctcttctgaccctatttctacataaatagtatttcttctccattcttctttcccctcaacttaatcaatgtctatcctgataactaacattttcgctttctgtctttcttatattattcaaaactatggacagtttcttctttgtacactttctctaatctttctatagcccaaggctttgatatcccaataccctttgatatgcttacttattaacaatgtaggaaacactgatagattttagacgtgacatggaatagaaacggaatatcaacatgttgggatgaggttcaccaacagactccccatacaaaaactgtaataccattgtcttctgacaccttaaggtgaggaccatgtataagttcaaaagttctgagtgaaacttacaaataaaaaaaaaaatctaagcatatcaaatatgtctgttgcaaaattcacacatacagagtgttcacttctcaagatctgctaagataacctaaaaattatgattggtttaggcagtctaaaaagacattttaacagtatttataaaatatgtaaagggagtctatattcaatgggaaaaatttcccctttttctaagagtttagagaaggcgaatccattttaaatcccttaacattcgtttaaaatctggataagttagccatagaaatcagggtaaacaggatgatgaaacagggtttgcaacttttgctttcctgtactgcctaaggagacgagacttggatggattcagttccagcaagtgaccttgcagtccacaaactcttacctcttgttgtttgaaggtattctcttggattttgccattcagattttctatgttgagctgcaaatcaagcaatgtggtattcaaacttattaaggacttggagatttcatctattgcattcccatgtccctggactgaggaaaacaaggtacttagctgcagaagaatgtcattaaatctttgatcagttgtcatgctgaaattttggaaatgctctgtgtccatgaggttggcttccatgtctaaaatatgctggattctcttctccatgttgctcatgtgttccataaagacttcttgaaatctcatttcctcttcgctgtcatttccttttcccgtgagactttgagttatatcatttgcattagttgaactaactgagcaattcttcgtttcccacttcaggagttgagctgtatatttaagtaaaaataaaccagtcatggcctgatccttgaatgcatacaggatcccatcccatatcattccattccgttcattttattccattccattccaacattttgaatgctaggctaaatcgagtatttttttttaatctacaacgtgtgaactacgctacgtatattgctgagaagcatacattctccctttcctattttacgttaagatgattccaggattatatcatgctttctgaattgctgcttatatgaatcttcttggccattgattttggccttgccaattaaaaaaaaattctatagattatgaaaggctatgtgtctacagaactgctgttagaataaagtggactaatgcttaatacagtttctgaagtaagcatgttgaatatgttaacaatggcagtgataatcatgatgatgacaaaagcaataagtggtgaaatagtggtgtcatgcataatatggataaattgttggtttatcttcttcattctttcacttgagctgccagaaaagcgtcattttcagttaatacagacctaattcacagttggtggagcaggaaattgggcaaatacattttttcactttataaaggtacgattctcataagactcctttttaactattataaaatatatattcacagcagaaaatttagaaaatatacataatatggaaaaacaatttaccatgaatctcaccatcctagcttaaactctaggattttggtgtacgtgtctcaacccttatcatattattatcttaaaatatgacatttttaaacaatctggaaacaactttttaatgtaatgctctatcataagtacttttttatattatttaatattattctacaaaaataattttaaaaactccattgtagtatatgtatggatctgccagatttatttaaaaaatagctgcatttagtttgcctctgttttcagtaatatagccaatgttttgatgaacaatcttgtgattaattatttcccaaattaaaaaaaaattatattctaaaatagtattttaggaacatactgagctgctgatagatatccccaaatgggcatatgttctctaaacaatctaattatcattctgaaataatctaaagcaatatgttttctagtttcaaaaaaataaaaggcttaaacattaactttttatgcaaaaataggccgggtgcgttggctcatgcctgtaatcccagcactttgggaggcgcagggaggtggatccccaggtcaggagatcaagaccatcctggccaacatgatgaaaccccgtctctgctaaaaatacaaaaattagccaggcgtggtggcgggcgcctgcaggcccatctactcaggaggctgaggcaggagaatcacttgaacctgggaggcagaggttgcagtgagccgagatcacgccactgcactccagcctgggcaacagagtgagattccatctcaaaaaaaaaaaaacaaaacatgaataattatagagaatgaggaaaatgttaaacacaatcttatcactattcagtcatggctgaggttttctgttttcctatatctctctatatgtatctatttataccttttatctacatgtatgttagtcatattcatattagattggttgtataagattttccgcatttgacaattatggaacaataaaaagaataatttcatattgctcaaaaatatatgcagctccacctgagtctatcaattttctaataaaagtgatatggtgatagtaccatttttatagatttttgagaattaaacaacacatgaaaaacatttagttctacccctaactcaaggattttgttcaataactaacagcttggtgtttacataggatctagttccctgattctagaatcttcctacactcctccattaccaactaggctactctgaacaagttacttatcgctctccttgctttggttttctcaatttgtaaaagtaacaattacctcaacagtggtgctgaacactaattaaataggcatatctattcctctaaagtgccttgtacatgagagacattatctcagttacagagtccaccgtatttactacctttacttaaagaggctgtgtgtggatcacctgaggtcaggagttcgagaccagcctggcaaacatggtgaaaccccgtctctactaagaatacaaaaattagccaggcgtggtggtgggtgcctgcagtcccagctgctcgggaggctgaggcaggagaattgcttgagcccgggaggcggaggttgcagtgtgccgagattgtgccactgcactgcactccagcctggctgacagagcaagactcagtctcaaaaaaaaaaaaaaaaaaaaaagaagctgtttgataagcattactactgtagctattattacattaagagtgtcatcctaaatatgcagttaaattctaatttcaaaaaatacatgataccatatttttccttgttttattaatttaatattagcttatgtgaaataacaaaatatgacaatattttgatgtgatctacaatagagtttgtattgagtatgttactctacatgtcttaacgtatcaataccttggaaataaaagtatatttcttaactgtatctcatcacatttattaaattcattgtggggaccaagttttgggttgacagcctcatccatgcattcattaattctatgatttaattcttatatactatgtggaaagtattgcttgagttactctgggaataaaagaacaattgggaatggaatttgactgtaacaatgaggagcccaaataaacaattttatcaaaattacttcaaaattttcctctaacgttgtccttttttgattattatttcttttgaagtagcagttaagaatttagattctagaatagaactgcctgggttagcaattctggctctgccctttataaactatggcgttggacaagttacttaatctgttattgcctctatttcaccacctgtataaatggggtactaatagtcagtgtccaaataattaaatgaactatatgtaaaatacttagaccacttcctggcatgtaataagcacttgaaaagtttcaggtttttgctatgattaatatttggattcaagatgtgtgattcaggtacctatatgcccaatattgattaactatggggaagtagcattgtgtgataaaaatctttttctggagttggatgttcatatgaacacagtcatctctctgctttattttactatgcacattgctctgattgctcaaccatatacttttactttcactggaaataagatttattttgtatcagtaaagctaatatttttcacaatatggaaagagaagccccaatgtgactaaggtcatatgaccaactatttttaatttgacaacaagttaaacatgaggtgacagtaaatgctacattttgttaatagatctaaaaacacaaattgcctgtttcatcgaaccctgagtgaaaactaatttttctataaaatgttaactttttatcatatatctaggtaaagaatgccaggatttatattttcaaaagttcacttatttttattggagagatggcattttgtgacttttctgtttcacatatgaaaggagacagaattttatggtctgtgcaacaacctacggacagggttatatttgattctacagatcatatctactctttcatattggaattatcttttcataccccaaatggatattgttttcagctaaagaatttttagtatttcagtaacaatttatatatatatacataaattcttgatttttatcttattgttctgacacagtattatgttgttacactctgacagtatttcagcagcttctttaagaaaagattgtaaatggaataaaccttataattaagaaaatacccctcaatatataattcacttcacagagttttatatataatattctatttcacccatgaattcatatttgccaaacttctaccattttagggatatattctgtctacatttgtaattttttatgccaagtagagatatatattgctttttagtttctttttgaaaaatatactgatctacaacttaattaaagttgtaagtggattgtgaattgtttattgttaatacataataaacatagtgaggccttttccaaattctggtgaatctgatactgatgtgtacttataaaatttgaacattcttagtgtctagtcaattttagtcggtacctactgtagtttcagtaaacaaactacttcaaatcaatcattgtaaactccagaataaatgtgttgacttggtagtattttctaatagctcggggactttgaacttggttagaaccttgaattattttccgactcctgtctgcactctgcacgagcctatcagaagctgcggtccctggtgctggtactgcaggcagtgatttgcataaaggtgatgaaatctactcaaattctaattggtttatatgtaataatcccaacaatgaagcatcatttagttatacatttcaaattacagataagcatagacataaacaaacatacagataaccttgatttaccaggaaattgtttaatgccaaacgtgtcaggtccttttactcagacaacaatagtttggttggttggttgttatggttggatttttgttttagtgtatttttaatggccaaaaagaagttaattgttacctctagaaaatattttcctgtggtgacttttttgttttttcttttttttttgagacggagtctcgctctgtcccctcaggctggagcacagtggcgcgatctcggctcactgcaagttccacctcctgggttcacgccattctcctggctcagcctcccgagtagctgggactacaggcacccgccaccactcctggctaatttttttgtatttttagtagagacgggttttcaccatgttagccaggatggtctcgatctcctgacctcgtgatctgcccgcctcggcctcccaaagtgctgggattacaggcatgagccaccgtgcccagctgacttttttgtttttttattggccaaccatgttgttttataaagacttgattaaactgggagacaagagaccagagtaactcgggttcggaagtcttggatgggaactccagctccaatactgagctgtctgaattttcttatgtggataatgagaataattacagtctctgtagagaggttaattgtaagggtgtattattgttttcattatttctttcttagtggaatttttgctctgtcttggaatacttccttagactgccctgtagcagaggaactttggcctggtctttaggaacttttttgttgttgttgttaaactgcttagtatgcacataaaaatgtatcttattcccagcctatctcttattagagcacatgggcagacattttatcagtcatatagagaagaggagagctataaggcatataaattcaaatgccaatcgaaatacatcaaatccatccaaaatgctacgcggggaataatatttacataagtgcttacggtgtatacaagctatctacccttgtagaaacagtcaaatctatctccggttcaagtcagaccctccaaagaaatatatacctcaggaacatcattttgagcccaagtatcacgttgtatattttttctttgagaagatactatcaggttatttttagagatattttaaataatatccctatgaaaaatgtggtcatataagctggattttactaagttgtaggccattattctacaaagtctcctctctttaaaaactgacagaaatattttttctgctctcagtactaagaatagaagagcttctcctggacaacaggctttttttttatattatagctattgttaatgtaaatgatcatcttacttcttcacattggcaaaatgaatacttttaaaatttgtcacccacattagaaggagaggactctagaggataatatatttttgaaagagcgtccttttcattttactattacaaatctgtatttttatcttgcacttctttttttccattctattttgttttttctaatttaaaaactatttttttctacttaactttgcggaatctgttttttaacttaacaaatttgaaggacactttgtaatgcagtattttctttatgaatgtaccatatacaaaagactgaatgcttcttttttgctttggcaatgaataattcacgggacgagttactaaatttcaaaactctgggttacgttacctgccactattccaatgagagggatgagaactgcaaacacgaggaggtaaagggcaatcagtgcagctttgaaggacttcagtttctcttgaagggaagggctgtttttaggatctaataaaacaaaaaagcccagcctactgttagaaagtgttgtcttcttccataattaaaattgttttaatctccaattatattcttactaccaagcctattggaataaaaaagaagaaaaaatgttccacatctttgcagtagaaagcaaaaggacagtcacaggaaaagccaatccaggtatcattataggcacttgactgacttatccactcactaaacatctacaagaaagttactgtgctctacaagttgtgcttgtttgatcttttggaatcagctggtaaattttaatatcgacacttacatatacaaacataaattttattcaatgttcatatgggaaaatattctgggtgacaataaaattttctaaagtaactatgcaattttttaatattttaaaatcagatagggcaaatacttattttcaatgactatgatgttaaaataattttcttgttcaattccttctcaatagttttgtatctgcatacctcttatgatttgaatacagtgtaaacaatatttaagaaaaatgaaataaagtgattcacatttttactaatctttagaatggatcaatgaagcccactctctctatatttcagaacatattaataacagtaaccttttattcatatgcatttatatggcactgtgatttatataatgggatattaattgtagtagagacaaatcaatataaaggggaaacagtagatgaggaagtcatttctctgattagttgaatacaatggtcattaaaaatttattttctatggtcattgctttcattgatcaattaaaaaaagtaaatgttgctttcaggttgcaaattgttaaattaaaaacaaacttttttattttaaggtattgaaaagaaaataagagacagtttttaaaaagtaaagaaaagagaagagctggatgcagtggctcacgcctgtaatcccagcactttgggaggccaaggcgggaggatggcttgagcctaggagtttgagaccagcctgggcaacatggagaaaccctggctctacaaaaactacaaaaattagccagtcatggtagcatgtccctgtaacccaagatacttacgaggctgaggtaggagaattgcttgagcccaagaggttgaggctgcaatgggctatgatcgcaccactgcactccagcctaggtgaaaaagtgagaccctgtctcaaaaagaaaaaaaaaaaaaggaaaagagagaaaaggaaaggaaagaaaagatggaaggaaaaaagaaaaagaacccataatagaagcaagtggagatatagtccacctgccaggttgattaagcctgaaaagtaggagtcatcttctcatctctaatttatcatcacaaatgtaaattctaccttttaaatagctctcaaacattttgattgctttttctctgctcccgatgtctctctcctccttcttcaaactctcatcatttctgtctgtaacagccctcactgttatcttttcttacatgtgtctcacttgtgccatatcctcccatccatcctttacacagagcacaagatccactgtgccctggagttgaggtctgtatttcaggtttgctatgtaagaactcatatatgaggctttaactttgtatatgctgcttcttcacactgaaatatcttctctttcttttctgcctccacccatccccttagcgatatgtatttatattttgaggtttagcagaattataagtaactttctcctgacatcttaaatgatcctgttgagatacagctgagtattgctactttttagctgttgtcgtaacctgtgcaaacatgtttcaccactgctatatgggttgaattctgtgccaccaacagatatgttaaagttttaaccataggtaccagtgaaagtaagtttatttggaaatagggtctttggagatgtaatcaagttaaaatgaagtgatattggattagggtgaaccctaatctaatgactgatgtctttgtaagaaaagaacaaatagctacagagagaagaccatacgaagaaggcgggaaagatgagtggtgcagctacagaggcaaggaacactaaggactgccagtagcccgtagaagctgggaggaggcacaggaagattcttctctagagccttcgaaagggcacatggtctttctgacacctgcattttagacttctgcatctcagaactgtgagcgaatacatttctgttttaagcctcccatttgttacaacaactctagaaaactaatacaggcacctaccacccatgattttcgaatattagctcacggtgctaggatcatatttatctccagaacctaatattgtagctgggaagccagaaggctcaatcaatgttgtagattaatttaatttcatataatactgccttacttttatttaagcttatttttattctgtctcaagaatacccctgttggtcaaataagtattattttaacatccacttacatttaaggtaagtctcaagactataattttatattttgtcaataactctaagaacaacctccatgggcagcccatccccctctacttactcggaggaagcaaagctgtcattgagcgagcatcaaatttcacagattcggagcagctatcagtgtcctcctgttgattgtgaaagtgatcccactgctccatacttctatgaaacaaaatggaaaaatatattaattccacatgaaatggctagggctcttttgcataatgttttaaactgaaatttcagtttgaaatggaatctattcagtttttcttttttttttttaattatactttaagctctagggtacatgtgcacaacgtgcaggtctgtcatatattatacatgtaccatgttggtgtgctgcacccacaaactcgtcatctaacactaggtatatctcctaatagctatccctcccccctccccctaccccacaacaggccccagtgtgtgacgttccccttcctgtgaccatgtgttctcattgttcaatttccacctatgagtgagaacatgcggtgtttgggtttttgtccttgcgatagtttgctgagaatgatggtttccagcttcatccatgtccctacaaaggacataaactcatccttttttgtggctgcatagtactccacggtgtacatgtgccacattttcttaatccaggctatcgttggacatttgggttggttccaagtctttgctattgtgaatagtgccgccgcaataaacatatgtgtgcatgtgtctttataccagcatgatttataatcctttgggtatatacccagtaatgggatggctgggtcaaacggtatttctagttctaaatccctgaggaattgccacactgacttccacaagggttgaactagtttacagtcccaccaacagtgtaaaagtgttcctatttctccacatcctctccagcagctgttgtttcctgactttttaatgatcaccattctaactggtgtgagatggtatctcattgtggtttggattagcatttctctgatggccagtgatgatgagcatttaaaaaaaaatgaaacggaatctatattctatgacacaatctgtaataaataacatttaattttagcaaaaaaaccataattagttaaatttgtatatctctcatatacagcaatgtattaaacttacccataagttttaactttcacgtaaaaagacagatgtatgtggaaccctctcatgtatctttctatttacaaacatgtatgtctatttttagaggtgtgttttttgagtgtggaaaaagaggtatctcttctttcttagctgaaaagttttttacaggtgacagaaaataacttgtaaaatgatttaatcagtaatttaatagagtaaaaggaaggaaataaagaaatgtctggatctgaatgatctgatttgacttcttacaaaagtcaattttcccagataattgttttaatttgcctctatctgacaaaagagaggatttgggaactatgcctgccttcctccatcctcttcctccacaatgtttaaatccattagagaacatagtccttgtccatatcaacataggattcagaaaaaacagttctcagaaatgatgcacatacaaattgtcattgcgaactgccaaataaggaatttccttagtattattttaattactctatttgctgaaaaaacaataatttcccttaggacaaatagttttgcatatttggactaaataaatatttcctggatcttttaagaaaattatttattggccgggcacagtggctcacgcctgtaatcccagcactttgggaggctgagatgggtgaatcacctgaggtcaggatttcgagaccagcctggccaacatggtgaaacacagctctactaaaaatacaaaacaattagccaggtatggtggcacctgtaatcccagctattcgggaggctgaggcagtaaaatcgcttgtacccggaagacagaacttgcagtgagccgacattgcaccgctgaactctagcccgggcaagaagagtgaaaccctgtgtctcaaaaaaaaaaaaaaaaaaaaaaaagtatttatttatttatttacttattttgagacggagtctcactgactctgtttcccaggctggagtgcagtggtgcaatctcagctcactgctaccatgttgtccaggctgatcttgaactcctgacctcaagtctgcctcccaaagtgctgtgattgcaggtgtgagccattgtacccggtctctctctttctctctgtctgtctctctctctctccccttctccctctctcctctctctcccttctttctctctctctcccttctctcttctctcattcactctttcactttccagagcttttctcattttacattggcagccatataaatatgtccttgtaccttttccagcataatctctattttatgtgcatactaagcagcttttaaaaatgttcctgtgtctctttaacatgtatcagaaacattggaaaggtttgataaaaagaaactgatgggcctcaccaccagagtttctgatatttggggtgggggctcaagaatttgcaattccaacaaattctcaagaggtgatgcaattggtctgaggaccacattttaagaaccttttccataaaaggtgattatgacttcttttgttggacacagttccgttcatgtgattgacaaatttagcataaagccaacatcttctgatcatttcttattttcttgaatgctgtgtaatggacttagcacagcacagttctaactgagtgcactggcatctttaggacagcaaagtcaaatccagctcaggaaatgaagggcgatcattcagatgcaaatgttcatcccactgtggggagaggcagtgacatgcaaggatatgactcaactcctgtcaatatattttgaaaatatcactaagaagattctttatttggaagtttgcagtgacagtcgttgcatattcctcctttctgagagttggttttcatgaatgctatgttgatctgaccaaggactctgttctttaatggatctgaccactgtggagaaagggaatgaagggaggtaggcatagaacccaaatcttctcctttctcaggtagaggcaaagcaaaataaataaacaattatctgggaaaatgaactattgtaagaagccaaactggattatttagatccacactcttctctatttcctccctttattagatttaaagagcagttttactcaccaagcaaaacaaatgaacaaaaaaaccaaataattaaaaaaaactgacatgacaataaaacttagcaaaattcactttaaaatatagttgaataattcataatcctttgggaatatacgcagtaatgtgattgctgggtcaaatggcatttctggttctaaatccttgaggaactgccacactgtcttccacaatggttgaactaatttacaccccaccaacagtgtaaaagcattcctatttctccatatcctctccagcatctgttgtttcttgaattttaatgatcgccattcttggaaccaatccaaatgcccatcaatgatagattggataaagaaaatgtggcacatatacaccatggaatactatgcagccataaaaaagagtgagttcatgtcctttgcagggacatggatgaagctggaaaccataattctccgcaaactaacacaggaacggaaaacaaaacatcacatgatctcacgtataagtgggagctgaacaatgagaacacatggacccagggaggggaacatcacacactagggcctgtcagggggtgggaggcaaggggagggatagcattaagagaaatacctaatgtaaatgatgggttgatgggtgcaccaaaccaccatggcatgtgtatacctatgtaacaaacctgcacattttgcacatgtatcccagaacttaaagtataatttaaaaaaaaaaaagaaaaacgaaaaccctatagtttaaggcaattggaactatgtactaatgctttttaactttgaactcagtttgtaaaagatggattcgcaaaaattgtgttcaagtatacctggtatgtatagacatgtgtcaattaaggacaaagatacgttctgagaaatgcattgctagtcaatttcatggctgtgtgaacatcatagagtgcatttacacaaacctagatggtctagcctactgctgctaggcaacaaacccaccccaggctgtgtggtctagcctattgctcctaggattcacacctatatagcatgttatactgtgctgaatcctgtaggcagttggaacacaatggcaagtatgtgtgtttctaacatatctacacatagagaaatgcagtaaaaatatggtataaaagatacgaagttctgcacctgtacagggcaattggataaatgaaacttgcaggactggaagttgctctgggtgagtcagtgagtgagcggtgagtgaatgtgaaacactgtagactttataaacattgcacacttaagctacactgaatgtataaaaaattttatttgttcaataataaattagccttagtttacagtacctttaatactttagaaacctttttaaacaacatttttactcttttataataacacctggcttaaaccataaattgtgtagctgtacaaaaataatttctttctaaacagctttatcctataagctattttaactttttttttttttaatgtttctacttctttaacttttttgttgataactaaggcacaaacacacacattagcctaggcctacacagggtcaggctcatcaatgccactgtcttcccctccatatcttctcccactgaaagatcttcagaaacaataacaggcatggagctgtcatctcctatgataacattgccttcttccagaatacctcctaaaggacatacctgaggctgctttatggttgaatctttttttataaataggaggagtacacaccaaaataatgattaagaagtataatatggtaaatacataaaccattaacatttattatcaagtattaaatacttacgtaactgtatgtgctatacttttaaatgactggcagagcagtaggcttgtttacaccagcatcaccacaaatatgtgagtaatgcaatttcctattcccttagaacagctatgaggtcaataggtgatagaatttttcagctccattataatcttatgggaccaccatcatacatatggtcctgtgttgactgaaacattattatgtagtgcatgtctataaccagaaaagctttcctttcaggctacctactggccccttctccacatgtttgattatggctttgatcctcacatttgagatattctgcctccatttttactgaaatgcaaaataaacagctcagattattctatctaccaggtaagaccgtttgtgaaaaaagctgaagacttttgaatctgataaacatctttacactctgaactctgaacgagtagggaccatgtctgcttttgtccacattatgtcactacagcctaaagcaacctggaacattgaatatattaaataaatattgaatatactgaataaatagaatatgctgaatattcatatatgaatagatgaataactatatagatataaatattcattatataattacatctataacatgtaatacatatttatatatacattatataatatataatttatattatgttaatatattacataatatattatataataggcaaatatataatatatataatatataatataataaatatattatcatattaatataacatatattataaatatatatttcccaattatattatatgtaataccatatatatttggcaattatataatatataatataaatatatgtataattatatgtaatttatattatgttaatatattatatattatattagttggcaaatatattatatattatatattttatatatcatagaattggcaatatataatattaaatatatttatattattatataatatataattatatatatatatatggcacaggcatagtacaaaagtgagtgattaactcttttggggaagtgggtaatcaaggtaggaatacagaaaagatgacaatgaatcagggttttgaaaatgagcagaatctggggtaaggtcattccaggatggaaaatatcatgttaaaaagcatgaaggtatgaacaatatggaactgagagcagttttaatttttcataaagacaacatttatttttcaccttaacatttatttttaatatgccttacttaggttaagagaaaacaaagatttaaaaagccaagtgtcccttttattattatactttcttttcacataaccttttcagcctagattcaggtaacttcctgtctctcccattaaaggagaggggtcctgcacattacaacaggcaaaaaaggctttcaggaaataaaatgttttaatttgatctattacatctgttcaattttcttgagtaccttcgagagtgggaaaaagacaaaaggagaaaaaaatggtattttaaacaaacagactataataaccttagttaggttggtagtacactatttatgctttttctctaaacaggtacaaaggaggttcaaaaagaagaggctggagaggcatgtagccggtagcatccgactcatcaatttcttcctttatttttctgatcgcataaattgatctggctttcacaacctacccaaaatataacattgaattactatctatacaaatgaagtaaaaatttattgtttgctttggcagtagtgacctggattaatattattagtgagacaatatatattgtttatgaaacattttgcttttctccctttcactttgaactagagatgaagcttgattttgttttttctttaagtttctaacctttgatttatttttttttagcatatagaagtgataataaatattttgtggattactatattttaaaccgtggttaccttgggaagatttatttaatctctgaaaaaggaaaaccacctagtacatgtctatgagtgatttagactaactgacactatttagtctataaaatacccctgacaggtgtagtgggccagaagggaggtgaacactgaagcatactcagtgcaatgaggaatgaacaatattccctatggctacatttgtgcaccatgggaagtctgtttgctttctgggcaatgttcaaaagggattggtttatcatgaactgcacgaaatgttggtatgtatattttccagaaaaaaaaaaaagctcacattcatcagagataatgaagccataggatttgtggcattttctgatgttactttcttttttcttagtctgcacagtctctctgagaatctcatctacttccatggcttgaactactgcctgtgtcctgatcaagccaatatagccaaaccagatctcaatctcagcatcagcttttgttttacataacacaactagctacaaacgtggattttctacagcaacctaacttttctttttccaggattttcactgtggttatatcatccatttacatcatctatttattatcatacccacttattattatcatctacttactgtatagtggagaatatgtgatatagttaggaatatgccggcaaagcacagtcacgcaatctgagcccagaactgcttttctagaccgctctcatctataagacccatatctgactgcacaaaaactcctgatttcctttgatccattccttccattctattccaatttttggacttcggcttatttttatctactccagccaggcatcttgggtaacagcaatggtgcagacaattaagaggaaaatccaagggcattaagagagaggacaaattaatagcatctaaaacacagcattttaacaaagaatcgtagggaaaaagtcaaacagtagaagataccttttttcaggaaaaaaaaaaaaaaacaccacacacataaacttgaaaaacatgatattcagtgggtgagtagaggaagaagactcagcacaaaagacaaggaagaactttttgacgctgcaagagaaaaacaagaagcagtcagggtcatggaaaagaacaaagaagttcgtggcctgcaagaaatccataacctgccacatagaatttaagttgtttttcctgtgtggtagaagcagaaataaaaccttgcaagattggcagtaataaatgtataaaaatgaaagtccctgagtgcataaatgaaagttgttcatgctcacggttttttgttgagaagagagatactgatgattgcactgagatagcacatccaggggagttttatttatttctgggtattcctcctcatctccccaacgtctcaacagcagagtgagccagggtccagtttctgttctgttttctctcctattttcactcccttggtgatctcactagcctcattgctttaaatataatctagaaggctgatgactcttaagtctttatctcttgcccatagctcgtctctcaactacaaacccatatatgcactgcctaacaacacccctgcttagaattctaatatggtgcaaacctagaggtcttcttttcctcgccttttctcatccactacatccaatctctcatccaaccctgttgctttgttttcaaacgctatgtagaaactgagggcttcttgtcacttccttgctagcatcctgtccaagccccatcatccctttcaccgtgacatttcttttttttttttttgagacaaggtcttgctctcttgctcaggctggagtgcagccgtgtgatcacatcactgcaaccttgacctcctgggttcaagtgattcttccacctcagcctcctgagtagctgggtctacgggtgcatgccaccatgcccatctagagatgcagtcttactatgttgcccaggctgatctcaaactctttagcctcaagcaatctacccacctcagcctcccaaatttttggcattacacacatgagctattgagcatggcctcaccttgttgattttaatagctccctgactttcacgcttacattcttgaattaattctccacacacttcccagaagaatcctcttaaaaagtaaggcagattgagtcactcccatgctcaaagcccctgaatgccttctcgtctcactcaggccgtcattaaagtctgactcaaaaaagcagaccacctgtaattcctgcactttgggaggctgaggcgggtggatcacctgaggtcaggagttcgagaccatcctggcccaatgatgaaaccctgtctctactaaaaatacaaaaaattagctgagtgtggtggcgggtacctctaatcccagctactcagaaggctgagacaggagaattgcttgaacctgggaaacagaggtagcagtgagccaagatcaggccactgcactctagcctgggcaacaagaataaaactctgtctccaaaaaaaaaaaaaaaaaaaaaaaaaggaaagaaagaaaaagcaagcaagcaagcaagctgactgttcctgaacatccattttcaacctacaaccccttggggctttgtcttccccaccctggcttcattttctttcccccaaaaacatatattccttatttgtcttgtctatcatctgtcttctctcatccaagccagatccatgatgtggacttttgatctctttggttcagggatcagagagttcctgaaggtgctcattacatacataatgccgtatttaaaattacataaataaatgaaaggcaagatatttttcaagatgactggattttatatcttaggttatgcctcaagaaaactttgtggttcactaaagtagggattttaaaaattcttctgttacatattggaaaataaaatatttctctctgcactgcacgtaactagcaaactgaaacaaaaaatattaccctcagtgaacccactttgcttcaaaagcatttattattaaaattaccagattatttcagctgcttactctggttataatcattgtaattttttagtaacgtgaacatacatacttgcatgagccttcattagcaggcagtgaacaactcacactgttcaagtgtgccttttaatatcagttccacagttaggacaaaaagtagcttcacataaagttactcttcctattaaatgtcagtgtgctgataaacgattgtaaaatccttggagtttgtgtaatctattaaaagcacgtgctcatgagaagtgaaacacgtttctgtaatatcagcattttatcaagtggatgaaaagtttacaggaaattcataatgaaagaatttcaaggttaatttgttgggaaccatataccttacttttttgtttttattataaaacattttaataatattatagatatgttaggatgaaatttctgtcatctcatcaccctaataaaggaaaaaaacccttaattttttaaatgaaactcgagtctttggatgtatgtatacctgtaacatagttcatatcatcatgcacgtatcatttggtattacgcgttttccttaaaatcacctcattattttaatatttcaaacgaatttttcaaacttgaaattttttttattattctttaggttctgggatacacgtgcagaacgtgcaggtttgctacattggtatacatatgccatggtggtttgctgcacccatcagcccatcatctaggttttaagtcccacatgcattaggagtttgtcctaatgctatgcctccccttgcctcccacctactgacaggccccggtgtgtgatgctcccctccctgtgtccacgtgctctcactgttcaactgtcacttatgagtgagaacatgcagtgtttctttttctgttcctctgttagtttgctgagaatgatggtttccagcttcatccatgtccctgcaaaggacatcaactcatcttttttatggctgcatagtagtccatggtgtatatatgccacattttctttacccagtctatcactgagggacatttgggttggttccaagtgtttgctacctaataattcaacacacatacatatatatatatatatatatatatatatataaaacaacatatatatatgtgttgaattattatgtagcaaagacttgcttatatatataaaaccttattttacatatatttcatatatacgcaaaaccttattttacatatatttcatatatacgcaaaaccttattttacatatatttcatatatacgtaaaaccttattttacatatatttcatatatacgtaaaaccttattttatatatatttcatatatgtaaaatcttattttatatatatttagatataatcttattttatttatatttcaaatatataaaatcttatttacatttcatatatatataaaatcttatttacatttcatatatatataaaatcttattttatatatttttatatatattttatatatataaaatcttattttatatatattttatatatattttatatatataaaatcatattttatatatataaaatcttattttatatatattttatatattttatatataaaatcttattttatatatatttttatatataaaaaatcatattttatatatattttatatattttatatatatgaaatcttattttatatatattttatatatattttatatatatataaaatcttattttatatatattttatatatatataaaatcttattttatatatattttatatatatataaaatcttattttatatatattttatatatatataaaatcttattttatatatattttatatatatataaaatcttattttatatatattttatatatatataaaatcttatttatacagccatttttctaaataaaaaatacagccatttttctaaaatataattttttcttttaaactttttttccttttcccagggggcaatgcttcactgatataaataatgatgttataaatatttcctttttttttttttttttgagattgagtcttgctttgtcacccaggctggagtgtaatggtgtgatctcagctgactgaaacctctgcctcctgggttcacgtgattctcctgcctcagcttcccgagtagcgggattataggcgtttgccaccatgcccagctcatttttgtatttttcaccgcgttcatccagctggtctcaaactcctgacctcaggtgatccaccctccttggcctcccaaagtgctgggattacagatgtgagccactgccccggccattattttcataatttagctttcttcttttaaaatgtttctttaggataattcatcatatgtgaaactaaaaagtgaaaggaaaactattttgaacttcttgggctctactgtcttagtgatctttaaaaagataacataaatttataaatattccagacttatatgtgaatatggcagtttcaagcaaaattcactaccattgaataataaagcttattttagaatcatttagattttgataagagttaaataatacctaaaagtggttttcatttttattttttattattaatgtaagagagagatttcactgtaattgtctgtcatacattgttcttcttgggttattatctattcatattcactgcttatacatccccacaggtttcttttacctaagcatgtgaatcagctctttatgtttaatacatatttaccatctgtcttttcatacttgacatgcattcgttttcctaagatttttccctatttagtttttttatcatattctttcttttttctttctttctttttgtttttgagatggagtttcgctcttgttgcccaggctggagtgcaatggcgtgatcttggctcaccacaacctccgcctcctgggttcatgtgattctcctgcctcagactccggagtaactgggattacaagcatgcaccaccacgcccggctaattttgtattttcagtagagacagggtttctccatgttggtcaggctggtcttgaactcccgacctcaggtaatccacctgccttggcctcccaaagtgctgggattacaggcgtgagccaccgtgcccggcccatcatattcttaaggccaactttatcttcaacatttggaataaataataagcttgtgatcctccttattatataaaataataactttgatttttgtaacagcagttgaatgtgtatataaaatgaaaattaaattaagattatttgtgaaactaacagctttatgcttaaggaacccgtctgtaagacagattttagtaagaaatggaaatatttatattgtgcctgatgtcactgatattcatccttggtagcaaagaagaaagagcatcaacttttgaatctgaaatctagatttgagtattgactgtgacatcatttagctgtgtgatcttaggcaaatattttaacttatttgaattgaactttctttagatatgtaaaatatgatcacaatataaatttaaagaattattgcgagaattaaaaataatttttgtaaattgcctggtacacagaaaaccatcaatatatgaatccctgttattttaaaatatcactttttttttaaatatgagcttttcttattttgttctcacggaatcttcatgaggtacaagtagtattttctccattttacaggttagggaactgaaatgtgtaagtaactagtcaagttactcaactagggagcaggggagctggaatttgaacacaggcagtctactcccagaagattagctcttacccactgcataaaacggctaatcactgcataaaacatctgtaatctcagttctatggtttttctataagtatttttacctggtcagtgcaaatgccaacctcccattatatgctgtgtgaatcttacttagtcttcaagattaatcagatttctagcatctccatgaagatttatttttgatagacttttttcacatagaagtaattttggcctcgcctatattttcatagtaattatctatagcattttcatactacttaaggtgctagtaattatctatagtactttcatactacttaaggtgctcaaattacattatgcctatttggggatatgttttaaatcataagattccggagcacaaaaagaactatatcttattttttgtatcctttccccacatctagttcaatgaagtgcatatagtagatacccagccaatatttgctatataatcaagggaagataataaaaggcattagattaaagccaaaaatgttccatgaaaagttatgaaaggagaataggtgaaatatgtcaaattatactttgaataaaaccagtattttaaacaaaatatgcttaattatatgaaaaaaccccattgctggttcaaactacaaagcatttagtgtatttcatatgtacttgtgaacatatatgtttttcactcatggaaaatttagcagaaatccctattttttgattatcgaaaaaaaccaaaccaaattattgctgatacaataaagcattcatctcatcatacacacacagacacacaaatatatatcacacacatgcatgcacacacacacacagagtacacacataacaatcaatagaaacaattctggaaaaaacattaaaataagcctttttttttctttacctttcgtcctaaagaaagcagcactgatttatccacttctctctctttacaattgaaacctaaaatctttatctcatagtatttcagcatctggtacatgaagaaaggaaatgacacattcctgcgttgaaaatctttcttaatgtgtttcaatagcactctcatcaatgcacaggtttgcaaaatctaaattt

SEQ ID NO: 987 - DNA, 177059 bp, Homo sapiens
ttaggttccaataaaattttatttatgaacactaaaatttgaatttcatatgcttttctcatgccacaaaatattattcttttgattgtattcaacctttttaaaaaccatttttagctcacaagctgtacaaaaacagacggtgagtaaattggcccacagaccggtttgctagcccctgggcttaagagatctgtccacttactcctcaacatgcagagtgtgaactgtgtgaactgcataggccacagcaatcttactgcatccattcccgctgcatcattatttttgatttgtattcattcagtccaccgaagcattcacttggcacctctccaaatctgggtactgtgcaagatccttccttgggacactgaaggaaaatcagacacggcccttctctcaagttcgcagactctccggtatccagatactacggctctcatagtatcagaaaacacagccacaagcgcaggtaagtatcagaggtgttttacgagatacatgtatcagattcttaaggctgctgtaccaaaataccacaaactgcatggcttaaaacaacagaaatttattccctcacaatcctggaggccagatgtctgaaatcaagatattggtagggttggttccttctcgagactctgagggagaatctgtgacatgcctgttttcctagcttctagtgacttcctccaattcttagggttctttggctcatagatgcattgctctaatctctgcctccatcttcccatggccttcagctctgtgtgtctatttccccttcttttctaagagctagtcattgaatttagggcccaccctactacaggttgatctcatttccaggtccttgatttcatctgcaaaaactttttccaaataatgtcacacgtggagattcccagtgaatgtatctcctgggggccactattcagcctattacactattcttagaagatgcctagaaggatatggccaatgttatccagaaggcttcatgaaggaggtaatagaagctaacccttcaaagatgaaagttggcgttcattagagggtcacaaggggaggaagggaatgtcaggttcagggaccagccagaccagagctaaggaagtgacatcacatggaacaatttgtgaacagcaagcagtagggcctggctgcaggacagggtgtgaagtgggggagcagtgatcaggagggccagagagatcagcagggatgtgatcttgagaagctgtgtgtgccatgatctggccctattaatccagaagggtctgatggaagcctctgtgattctcttccatggttaaacattttaattgtattatacctcggatattcctaaatatttaaaacactggcatggttgaactagacaacctttaagtagtttgttccaaccatgagatttagatttcatgatttaggttttatgatcttaaactgaaacctgttagttttctaccactagtgagatcatggcctctgcttttctcctgggaagtccctcttataatcactctcttcccatgattaaagggctactctgccttcatgttgctacccgctcccctggaaatggagaatcaagcaaggatgcggttttccttccattactacatccatacaagagtaaatcaagaataaaagtccagttaatgaaaagatcactggtcttaatatacttagcaaaattttaaaggcaattaaaagtatatacatagacaatgatcaaaattctaatgaaaagacccggctctcccctaaaagaagaaaaaatcatgtaatgtatatatgcattccataaaaacatacatggggaaaacttcagaagcctaaaaacaaaacatcagtaaaccaagccacacttagaaaaatgaaagctgatttttattttatcatcaacagccattctttagacatgaacatgcatacgtaatattctacgcacacatcacagcttttaacgttagttaataaaggttaaacacacaacatacatccttacaaaaaaagtcaaaatgcaaacttaaaactttaaacaaaagtattactaatttaaaaaaagtttgtgttgggtaccatttgtacaacacagttaatttaaacattttcattttggttgcacatgaaaaaggcggcagtagaaaataaagtcattgagggtttttaaatagcagaataggcagttttgccatgcaggagaagcaatattaaatattagtttcaaaaaaaatccacatttaaaaatatttagttcaagtcacagaatttttctcagtagagaccccaatgcaatgcataattagctgccttagatggcccgtttgaaaggatgatatcccttcagagtgtaactttactgattttggcacagaaaagaagtcttaagaacatgattaaaaaagagggaagaggaacagaggaaagaaataaaagcaagaataaatgagatagtaattgcaatcactaaaaaactgcattctcagtcattgcagaatactgtcttctgtctacagcaggtgcttattccagaattgttattgcagcatggatttaatttgcttggaggtagtctcatcattcaaatgttttgttgtgtacctaaaaaaagaaaagaaaaaagatcaattttaggaacttaaaaaataatcagcatcgggttctctaattatgacaggatggagaattggtctcagcaaaactcacaaaattatggcttctcattgtagctttaaccctgttcaggttctgcacagcctgtcatcctcaccccctttctaactgaatagccagtagctatttagcagctatttaacttagttacaactacactgctgaaatgattggttgacctctcaagtaaacaattagctgtaacttctccctcagaagaaaatgctgttctatcccagaggctggcaaattatagcccatgggccatccaatccaccaatttttttgtggactgtgagctaattctattttttaaccttttggatgactggggggcaaaggaagacaaaaaaagaaatagtaatatttcatgtgttattgtggaaattctatgaaattcaaatttcagtgcttacatataaaagttttactgaaacacaccaagttgactcattcatgtatcatctatggttactttcttgttatggtggcagaggtgaggagctgtaacagaaaccatgtggcccacaaggcctttaatatctacttactctctggctctttacagaaaagtgtttcaaccccttttctattctgtatttaagatgcctcaattactacagctgttatatctctaaaatgtctcaattctcccaagtgccttatttctaggcatgtgttttgctacatgcatgcaaatccaacataagaatccaaaaaagaatcacaaagagtgattattataaagattcacaacagtattcccttaaacagtaaaaatccactaagcaagcttactatgtctcaggcactgttcaaggagcttacaacctagcagacggagaaagataatgatacactaatattagtgacagggtaaagcctagcagcaaaggagagaagtataacaagaagaggctacatacagagacagggaaacaccatctcccatggacacccagaggccatacatagtaaggagtttggagattattttaagtgcagtaaaagccagtggagcatattaagcaggagaggggtgtgctgccacttaagttttatcattctggctgttgagggcaagctgtggagaacagaaggagcagcagggaggcattaaataagggggctgttactgagcaccaagtgtgagataatcagatgtcaaggcttgggccagattacagcagcaatggagacaggtgttcaatgcgtgaatgtggactgtattttggagataacccagacagagaaatctggttcacaagaattccacatataatcttaaggactagatcgttttttctagagataaggtctggctatattaccccggttggccttcaattcctgggctcaagcaatcctcctgccttgggctcacaagtagctgggatgacaggtgtgtgtcaccatgcccagctaggactacatccttttcagcaggtccacatagatctttctgtgtttaagaaatttaaacccaattcctattaggttcatttcaaattaatttaaaaaccgaagaatgcttattaagtacctgatatactgtctacaatgttactgagaagtcactcccaaactgttctcatgtttttgaataggtatcagcgtgcctggcacataaatggtgctcaataaatacttgcggaaggaagacaagataagcagccaggttggaaagaaaaaaaaatccataaaggaatattgacattaaatgctaagtgatgtcacaaggatttaacctttttgttctctttatgtagataaagtatacgcaattacacgaaatcctacagatgtctcgtagttctcaaaattcttcatttgtttctcctccacttctttatacaactaaatagtagaaagagccaagcaatgtgcacagtaaaatttctactgcagagtagttaaaagtatcactactcagcaatgtactgtactattcaaagagtgctaagtgttttcctctctacccatgacgcaagttctcgctccttctgtgggatgtgatcttggcttccttctttggacaaagccaatccagagcacactgcatcaccacactcacttatcaagaaaaggccaatattatctaatatacgtgaaaataaaacatgaagatatatggcattattttcctttgtgcacaaaaacaaattttttttccaagtgcgactgttttactaaagaaaaccaattattatttacctttactcttaaatttaataaagaagacaattatctactactgaatctgaactcccagctctctttttttctttccctcttatgattaaatgtatttggttccatttttccacctgtaaaatggacatatgacttgatgccttctcttagtagcacaggaagttctatataaataattactacaggaaagcattcaaaacaaacatatacatacatatggaactattctctcatttaaaatcttttggtctttaagttctattttgtggaggtgtgtaacactcgtgtagtacttttggggttacaaaatgctttctaaacatgtgctctcagtaaaacatattaaaggctagatggatttcctttaagaaatatttttcaaagtatcagcattatctacatcagctagggtgtttgtttaaaaggaaagtgcctgagtcccaagtcagacctgattttgttgtttctaaaagcaacattttattttctagtttccattatctattataataggaaagaaaatgtaccaaactgacaggtgactcttgcctccgtggtgctttccttccctcccctctccctcaaacacagattactttgtgggagacttcaaccctgtctttcactcgccatcactggtctcctctgctttcattctaaggaaaaggaaactgaactacccttaaagtgaaacgtagattctgagttaggcatactaccttcaagctcaagaaagaatcctaaaacctcctagatctcaattaccttcaagtttttaaaaaagatttcctgccacttgctggcttcaaagagcctgaccaatcagaaagacaaagtcttgggagaaaaatcaggttgactgagacacagggagtattcagaaagaaaccaaggaggaaagactcatgatatcattaaatattggcaaaaccactgaagtatgcgttgtaaaaaccccaagaatacagaattctaaaaactaggcttatggttaaaatagtttgacattataaggattttaaattatgttccttaatcttgctgatgttcatttagaatagatcacctttattcaggcagctaccgcttatgcaacacttttcataatcttttaaaaactatttttaaacattttttcataatcttaataaaatcatttgacagttccgcttagctgaaatgatacagcctacattttatgtggtaaatatcattatataaatatttctgtgttcatgtaatttttgtgtttaaaccctcaaaaaatcaagtaatgggacatcatcttttatgtcatgtgaatactaccaattaaatctctgtagtcaaatgttataaagtatcgagattttcatttaaaaatgttctagcagctgggcacagtggctcatgctgtaatctcagcactctgggaggccaaggtgggtggatcacttgaggtcaggagtttgagaccagcctggccaacatggtgaaacgctgtctttactaaaaatacaaaatacaggcacatgcctgtgatcccagctactcgggaggctgaggcaggagaagcacttgaacctgggaggccgaggttccaataagccaagattgtgccactgtactctagcctgggtgacagagcgagattccaactctaaataacgaaataatgttctagcatttgtagaagtttgagcaactaaattaagtaaaactaatctaagaaaagacattaaataatgactacttaatttttattgtaggaaatacataaaaataacagaacacaagtctgagcacaaatgtaattacattctattaagaggaaagagctagttacaagccactttgtaagatattattttgtaaaaagataactactacatagagctattatctatatatgtaaagaaaaaactctggaaggctatatgctaatagtggcttatctcaaaatggtgagattacattatttctttttatttacattttcttatgttttctgaattttatttataactggtatataatacttttattacaaaaacaagcaatctctgtttgaagagaagcaacaagtaaaagccaaaatcttcaaccagaaaatgaagctgctattgtcatgtgtcccacacattcctcatcataaaataccgtaaccagtgtttggaagcaagattatcaataaacaaaataagatcttcatatttctagcttgaacacttatttttatatcctattcacacttaatgcattttctttacataaacatcgaccattttccttacagattttttctgtacatacgtacacgtacatatacacacctgagagcatttagaagaccttccacactattaggaggttggtccttaagaactttgatacaacctttcatctaaagaaaaagaaaacagaaaaggtaaaacagccatttttttcatgtaacattccttttcaaaatagtaaaataaatcaagaccataactatggaactcaagagattacatactatgtcaaattaattattcttagaacagaaaaaaacccaacctaagagttattattctcacttagtgaaaacaaaatctttttgagaacaaaatcagtcaaactaatataccacacatgcaatgaaaaacaaacggtttgctaagggaagacttctggaaaaggtgctgagtggcgatttaaaggacagaatgggctgggcagggtggctcaggcctgtaattccaacactttgggaggctgaggcgggcggatcacaaggtcaggagttcgagaccatcctgcctaacacggtaaaaccccgtctctactaaaaatacaaaaaaattagccaggcgtggtggtgggcgcctgtagtcccagctactcgggaggctgaggcaggagaatggcgtgaacccaggaggcagagcttgcagtgagccgagatcgcactactgcactccagcctgggtgacagagcgagactccgtcacaaaaaataaaataaaataaaaaataaaggacagaatgagtatgttactaaggaaaagaagaactttcaggtagagaaacctcacagagtaaagtatcacacagaggacagataggaatttttcagcactgcacctggagttatgagaggctgaaagccaggatgagttatacgaagtgttatgcctggcagcaggggactcacaggttattttaaaaggtaaccacttgatgacgatggtatttaagatatattagcctggttgttataaaaaagcataatacagcagaaagaacacaggctttggaagccagagaaatgtgggttctaccttttctagcaactctttttatttttgagatggagtctcgctctgtcacccaggctggagtgtagtggcgcaatcttggttcactgcaacctctgcctcctggatttaagcgattctcccacctcagcctcccgagtagctgggactacagatgtgtgccaccacacccagctaatttttgtattttttttcagtagagatgaggtttcaccatgttggccaggctggtcttgaactcctaaccttaggtgatccgcctgcctcggcctgccaaagtgctgggattacaggcataaaccactgcacccggcctactagcaattctattacttgatctgctaaactttagttgccctgtcagtaaagggagatgacacctaaaagagtattttcagagtcacaagggagaacaaacgtaaaattcctgggacatggcaaccatacagtaaatattaactcatttctctttacatatgacaggtgtacatgaaggcaacaagcttggctagtaatcagtaatcgagatccgaaatgctaagagcctaaactagctatgaaagggaaacgggaagacaattctcaccaaacactaatgaactagatgtgagaggttggggaaagaaactacgaagtagagaaattagaaaactatttctaatacaaacttttacagagagaagaaaagtcgagagccaactatagtcacaaattattatgactaggtaggggagggaaaatacataaagtcttcatctttttccactggagcatcctactggctgtctttttaatttcaagacagggtctctctctcacccagactgaatgcagtggtgtgatcgtggctcactgcaggctggaactcctgggctcaagggatcctcccacttcagcctctcaacgtagctgtgactaccgatgtgtgccaccacacctggctaattttttttttttttttgtagaaatgggggtctcactatgctgcccaggctggtcttctactcctgggctcaagtgatcctcctgcttcagcctgccaaagtgcttgggctacaggcatgagccagcacgcccagcagcactactgactttttatatgcattctgaaataaacattttatttgaaatggcctttggccaaaggaattaaaggatatgactcaaaattccttatatctaattatctatttatattgccaaatacgtagtagaagccttccaggaggtactcactagacaatatagtcatcctttgatcattctattccacctgaatacaggccacaagaaaaacagcacagggacagaggagatgaaagtccaccatttcacaaactataaatctgagttttgtgagagtccggtttgctggctcttatcataaaataaaatcctatggtttccatggagaaactcgtttgaaattatttatataaaacaataacttacatcaattttggaagttttagcaaatgctcccactggatgtacgtggtcatagagtattatgacacccaccattaccctcaagcagaatgacactgtctcttcatttgtaaatctgcttctgtattccctgaagagtagataagatatgcatggaagaagtgcattacaaaattctttttaaaaacacacacacacaagaaaaacctcttctgaaatattttattcaaatttctatccattagttgaatgcagtatgttcacaagtagccacactgatacattcaaatcttatgtctgttttcctttccaaatcaaccccctgaaagggatataaaattctttaatgaggtgattcaactttcagctgatgctgacttgcccctttgatctctaaaaggtatactaacattatgccccttactccacaatgagatccccagagatatgagaagatggtgagtggaacagtcatcacccatgtattctggtttctataatatctgcacccacattagtgcactgctcctctgctagaccgatagcaacaattttagagaatagatgctacgtaatggttgttagcacctatagtgaaaaatcactagcttaatagagcaagcaggtttgctatttaggtgctaacttgatctaaatacattatagtattactggatatcaattttactaaaactcaatcatattctcctctcatttgtgaaaaagaaaattgaacttttatctatatatagaaggcagtatatcatagcggaaagagtacggaaccaggatagagacatccaagcacatggatagtgtcccttcatttcccaggacctcactccctgaagttggtggtggggggaaggaagatgattatgatgatagttgccctcctatttcataaggttttccaatgagatgatgtacagtatagtgctttggaccatcatatatgtggcccattgttgaccaaaacgtcattaagcagcacatgactgtatttattattctggaatccaggagggattctttctgcctgctaacaggaaaaatccagccaggacacactgtatcatacatcataaatgtttagagaggagagaaaaaaaaacagaattcaggttcgtgttggaaaaaaaaaagaaaagagtgacaattaattattgagagaaaaagggataaacagaagaataattccagccctttggcaaaagggtaagattctttactaaatatggaaaaagaacatttatggtaagtataaccaaggaactttaaagttcttctcctacatcccagccaccaaaacaccaccaccacttctgttctgagaagagaactaagagtctgagtcagtctgagtggtctgaggtacctgaagaccaactaactctattttatacttaaccagaagttacgttaaatagccaaattattttaagtttgttcatatattaacattcaatatttggaatatacttactttccaccttccagataaaacatgttaacatgttcatatatgaacatgttttgaaatatcagtcatctcaacagcactgttaaagtgaaaaagatcagctgatactcacggtgtttccagcatgactctgcatacactagccattgtgcttaaacaatctgtggtattttctattggtaaatttttattctgtagaagtatatgaagaacaaaaaaagtaaaagtaacaaacgttattacttaagcacaatttaaaatttagcgtaatatgaaaaattagcaactttaaaacctggttcctactcctaattttctaaataatgcactagactctaagcaactgttccaagcactggggatacagctatgagcaagacagcgaaggcaggactcttctgaaaggcacctgcattccagcaatgtaagaacaactgcaacaatgcagacagggggtcaaaggtgtagagttttataggctatgaaatagttggattttatcctaagggtactaggaagtcactgggaacattttacatggaggagggagggaacatggtttatgttttaagattacttggttgctctatggagaaaggactatattggggcaagagtggaggaagtaagaatggtcaggacacgaatgcagtaatccagatgagaagtctgatgtggctggtggcaagaaagcaacttaagttttcagaatcatgatatattagtattttggagggaaagccaatgagactgtttgatggaatacatgtagggagtgaggtatagaaaggaatttaggatgatggccaggcgcggtggctcatgcctataattccagcactttgggaggcggaggcaggcggatcacctgaggtcgggagttcgagaccagcctgaccaacatgcagaaaccccatctctactaaaaatacaaaattagccgggcgtggtggcacatgcctgtaaccccagctactagggaggctgaggcaggagaatcgcttgaacccgggaggcggagtttgtggtgagctgagatcacgccattgcactccagcctgggcaacaagagtgaaactctgtctcaaaaaaaaaagaaaggaatttaggatgacataagttgtaagtttttgcctgcactggtactgttaattgagaaagcaaaaactaaagaaagggcagggttagaaaacgcaacccagagtttggtttggccatgccatcagctatcactgaggtttccaccatccctccagagaaactgcaaatacgtggacaggtgtgcacatgtgggcctcagaaaaaagtcaggactcaacacatacatctgggagtctgttggtttcaagatggtatttaatgtcttgggcttgctgacatcacgtctgccaacaggggcataaataacaacacagagtacctgcctaggcaatgcttacctctgatacaaattttgttgtggcatcactcaaggttttcagcattggagttgcctcagcataaaacaaagacattcgatttgccaattcattatttacttcattttctccttctgcctgtggggaaggtaaaagcactggatgttagttcacaaattattacatataataacaattatacaaggacccaggcagggtgcctgcctcaattacattttagactctcatgtatcgataatactcaaatattctttttaaaaaaaagttattttttttaaaaaaagattaacctcttcaaaaatattttaaatgatattaaagaatttaaataaaaccttgatgaactgtctactacatacaagagattctaaatgttatggaggacagaaaaatgattataaaattgtaccgtcctccattatgaacaataagtatccatacaacatccatggtaagattctaacaggtgataacacaaaaagggagtcagagaacattaagttggaacagaagaaactaaggagaagagttatccttttgcaggtcatattgggcaggtaaacaaggtattccaatctggcaggggaaagagtatgttttcaaatgactccctaaagagtaattcagcatattcagtgtaataaggggctgcaaccaacgaaagatacaggttggggtcagactgtatagtgccataaatgctagcttaagttcatatttttcttccatgtggaatggggagccattcagtgtgttagatgaaaggaatgacaactaagtcagtttcctaaagaaaattaactgataatcgtgggcagattgtaccaaaatggaaaaagacttgtaggtccgaaaatgagttatgctgtgcagagtgactgccagaaagagtgggaattaggctctctgttggaacagtgggaggaggagatggaaagggggatggagaagacatttcagagatatttcacttgaaaaaaattggattttacctgtaattattgagggtaaaagggagaaccaagatgactaatgtctttagccttaagtgatggcaaggatgggtatagtataggattggctgctttgctttttgcttttatcttattttacatggtaggtatgaaaaagacagatgttaaggtcagtctcacacgaggaactggtctatgcaaaaatcaaattgatgcaaattacagatgtttcataaagaggaatcttttcctccaactcagtgccttagtgcaagtgcttcctaaaatattttttcaaggaaaaagaaaatgaatgatagtctttgatatatatattttaaatatcttatgccacttattactccttacatagttacagtatttctctattaaactatctatttgaaacaagggttgatctttgaaatttttcagaccaattataaggttctcagaaacacagagaacaagttaatattttcttccgctctagttttacttatggtatttagttccttggaggtagaaaagagtaataaacagcttaagaggaggatggtaagaagttaagagacctaaagaagccagaagaaatgctatactagccaaggagcaggcacaaagccattttctcaaacagctatatcaggcacagatgtgttaacaggccatgacctcactatcacctcttgccagcattaaccattaatttcttggaggaaaacggacttgggttcaagatttctctccaagaaattaacccacgtcaatttctctccaagactcttccattctaagaatatagagacaaaaaactcgtaactatgaattcacagaatttctgtacagttaaaatgagagtacatcgcgaaattttataaggatcaacgttatacagataagcaattttgttgaagtagttgtgggaatttaagagactgtgaagaaaaacaggtaaacaccatatggtttgttacagtttgcttttcctcctacagctatggctgcccataattactaactttattactagctttaacactatctgaatgaacaaacaaaataataaaatgaacaggctgagcactaagttactcttaccatccccctaattcaaagcattaacttaccggtacattgttaatcctcatacgactcaatgttcttctataatagctgaaatcattctgtatggcaggatttgtcatctgaagaagacagttgtggaaaaaaaatgttatgtactaaatgctaatgtaaaaaaactaagtaaaaaatctttagttttaattagtataaaacattccataattcatagtatcattttaagaactagcactggtataatccaaggtggcttataactgtatttagtccttactgaacatataaaacgaaagaccacaggcagtatactttcccttttcttttcagttaatttcaggtaatgtactaaaagcttgtttatcaaataaacaaaaacaaaaaggactgtttaggcacttgtttttagttattacgataaaagtatgtaggtatggtcaacagagcaatcctcaaactagaattttacatacaaatctgactgtgatacaactataaaatgctgaagtttggaatccagctcttccattttctagacagggtaccagaggccctgaaaaatcaaaggacgtgcccaacgtctcatgactagggttactgtggcagagtataaactggaactcaggtctcttgatatgagacctagtgcttattcctttacattcattctttttaacaacaaggtatttatagttccaaacactataaacaatgacagaggaaaaaagaaacagaaagaaaggaagaaagcgggaaaggaggaagggagaaaaaagaaattttagcaacattttaatataaaagaatgttgaaaaacgggggtagagggtgtgagcagaaaagaaaaagtattagaaaaaaagctcaaccttttgtttcggagattaatttttaaacaaggttaaatgaagactgctgagacatgtggatcacctgaggtcaggagttcgagatcagcctggccaacatggtgaaaccccgtctctactaaaaatacaaaaattagccaggcgtggtggcacatgcctgtaatcccagctacttgggaggttgaggtgggagaatcacttgagcccaggagggagaggttgcagtgagctgagatcacgccactgcactctaccctgagtgacaaagcaaggctctgcctcaaaaaaaaaaaaaaaagattgagaccgaatactcagtaatttgctctttgccatgtatcaaaagacccgtcattaatttctaaatccagctttgcatttttattaaggtctagcagacatcatttaaatacattttaacaatgtttcccggctcttcctcctagtactcattaaaagattcatgattttcgtaacaatcagggccaatagataattctaccttgagttcatcaaaccggagtgtgaaatgaagaatttctgcaaactgtttagcaagagcctgctctcgctctagatgctgggtgggagaatatggggtacttgttaaggctcccagaagacctcttaatgctgcttctaaagaaaaaaattgaaaaaaacattaagttgtttgtatctgtgtgatatttgtttattaaaaagtgaacaattcataaatgttaattcccagaaaagttctctttaaaaaacagatgatctaaacataataaaactaattaagaagtttaaatgttgccattgctaatgtactacacacattctgaatactatttaacagaataaaaaccttaaacggactaattcaagggtttataattctgtaaacccagattgaaaatagtgcagaagtgaatttgaattcaacaccaaagggcaagttttatattactttaatcacttcacacagtgtggaatttggttttatgaaatggtaactattatctacagctgagtaactttcttcaatggcactgtgtccacactgtctgtatatgcctatgaatcaattaccaatttctcatactttgaatacatcctttatttataaccacaaactgtttgctttcagctactaaagagaacaaaatatgtggttcaataagcttcttgtcttagaacttgacatttcaagactacaatataaatattctaattcattatgtgagcaaaatggtccctttgaaataagtgctacttttgggatgccaggctaataaataccatgtttgataatggaaatactaaatactaatactaatattaaatactaaatactaatatttcatttcaatatttcaaaaagccatagaaatcaaatgaattcagttacagatcacagaactggaaaatgctgctagattctggtcagagaaaataagagcttacagagttaaactatgatctgatgttaataaatgtcagattaacaaacaaatattaatgataaatttaaaactttatgtcaggtcatcagcccgtaactttaaaaaaaccccagttttcctatttatgaagatttacgtatgagtcaacatctactgtacactgaatatagtctcccatttgatttttaccatcaactatgacatggtcattccagatggatcaaatgagtttcaaagaacttagagcccaaagttatagctagtaaatgctaggtatttctgactccaaagccctattctttctaccacaataaactgtctctgaaataaagcaacattgtacgtagcctctgtaactttataaaacattaacctcctgattactaccaatagtaccaattacttctgtaaccctacaaaacattaatctactgattaaaaacaatagtaggtacttcctgtgtgtctgtcagataccaggtactgaactatttcttcacagacattatttctcatccatgtaataactctaaatgacagctattatccttttttttccagtaagtctgaaaatgtactgactggctactctgtgccaagcactgggaaaatggatgtagacagacatgctccctgtgcccatatggagccttattatatagagagaagacagacaaatgattacagctgtgatatgtgctgaaaataagtacagtggaaaggtataaaaataagacctcacctaatggaaggcccaggaaaagatctccctgaataaatgactcctggactgagactgaagtatgtagtaaggatgaacatgagtttgcagacagaaaggcaggaagccagaccctgaactgagaagagcatgacatacttgaggaactgcaacaccaccaatataggagcacagagggcaaggaggagggtaaccaggactaagatgattcatacacatgtaatttgtggaccacattaagtactcgggctttggcatcctaatgtccctagagaaatcatctaagcagaggagtggcgtcagcagattcgcattttaaaatgctacttcatttgcagtgtggagcatggactataggggtatggatggtgtatcaaggtgtaacagtggatgtgaagaagatcaattaaaagtcaaacattttgggttatattttaaaaatggtttacttctcccaagattcattctttctgttggtgttaactggaaaactaagtaagagagacaccgaacagaaaaaaacatttttacaaaatattattatagtctgttaaagaaaaaaagaaaaatgcatctgcctagactttatcaagtctcagggttaatttcagcattccaagttctctaccacttttgggactggagtcaggtcgcttgactaagttgggatggtcagtgaccagtagttgcagaacttttgtctatgaatggctgaggccctccatggtagatctatgttgaaagggaagctcaagatgataaatctgctaatctgcctttgaagcagctagatcagcctcaccctgcaggcctgtgctggcacaagtcagtcctactagcctacaatgctctgtctcaagagagaaactggagacaatcccacagaaaatgtcccagaggtctctggatgagttggagagaaagagaggacaaagaaaagatgcctgggattggactcagatgaagctcctaaaacaaaaccatgagattatgattttttaaaaagcagatgaccaggagaaaattaatagtctattaagccctaagttctggaagaaccaaaggaagctggcagatgagtgcaggagccaaaaccacagaaggaggttgcaaggaaaagacaactagaaggaatgataaagatgacaaatcagtccacaagctaggacagggaagaataactagttgattaggaagaggaggcccctggggagagtttccctatagagacaacagtcgtttattctcatcaactgccatctatctactctcaaactctcagaagagaacctgaggacatggattctaaaggatttaagacaaccaagagtcatgaccacaattaacggtgggcatttggggcctttaaaatacattttgataaattctgcccagtgaaacgaagctaacatgttgaagggacttattatgacccttggaggcagtccctaatgtaagcccctaaagcatgagcaagactgaggggagacaaagcagtttgtcctactacctgaccatacaaccttcccttaggtatctgcctcaacaggaggggctccaaggcctcagaacaaaacaagcaagtacagaacaagcaagtatggcaagtttactgtagggtccagccccacagggtcggtgggtttctccccgtgtgcagagacgagagagtgtagaaataaagacacaagacaaagataaaagaaaagacagctgggcccgggggaccactaccaccaagacgcagagaccggtagtggccccgaatgctaggctgcactgatatttattggatacaagacgaaggggcaggataaggagtgtgagccatctccaatgatagggaaggccacatgggtcacatgtccactggacagggggcccttccctgcctggcagccaaggcagagagagagaggagaaagagcgaaacagcttacattattatttctgcttatcagggacttttagtactttcactaatttgctactgctaactaaacggcagagccaggtgtacaagatggaacataaaggcggactaggagcgcgaccactgaagctcagcatcacagggagatggttaggcctccggataactgcaggtgggcctgactaatgtcaggccctccacaggaggtggaggagcagagtcttctctaaactcccccggggaaagggagactccctttcccagtctgctaagtagcgggtgtttttccttgacactgaggctaccgctagaccacagtccgcttggcaacggccatcttcccagacgctggtgtcaccgctagactaaggaggcctctggtggccctgcctgggcataacagaaggctcgcactcttgtcttctggtcactcctcactatgtcccctcagctcctatctctgtatggcctggcttttcctaggttatgattatagagcgaggattattataatattggaataaagagtaattgtaccaattaatgattaatgatattcatatgtaatcatatctaagatctatatctggtataactattcttgtttcatattttattatactggaacaactcgtgtcctcggtctcttgcctcggcacctgggtggcttgccgcccacatttaccagggcagtgtagttaaaccctgtcagcaaaactgagtatcttcaaattaagcaggtaatccttgccctgtcccattgtaagtatgcaaactggcaagggatcagggtccttcttctgaagtataacccatggtgtatctgtagtgctcaggccaagaaaccttctccttagaactgcaagattctgaaggatcatgtgtgtcttcatagttgcatgctgctccatggtgctgtttgtgctggaatagcacccatgatgggacacacaccacgagaccgattaattcccatggtaaaaatataacacttaagtccaactagtttggcctattttacaattattctttgtgtattgggatatgctaaaagaccaagatgagcttgaatagcatctgagcaccatcaaaagcaatttaactataaatgcagccagaaaccagcgtaagaaaagctgtatatagtagagaagacaaccaagacagaaaacctaggctgattgggttataaagtgcaaagctacaaactatagagactcttgattgaaagacaaatactgtaaaataactaatactaaaattgggaaaataaattacaattcttatttccagtaagaaaaagataatttatacaatatttctatccaaactactgtctgtcttaacattacatttaacaggctgtactgcatctaaaggaaaaacagcaactgtcttacttttttttaagaacataggcatttttaaaaaatggaacttcaacttcagaagttacaaatacaaatggccaaatagcaaatataaatatagtaagatattaaaaaacatgaagcaataaaaacttattacaaactagaaagcacaagtcctaactaatggaggcagagatggtttgccatgtggttctggctctctaacatgcagatcaattattgctagttggaggcttaaagaaaaaaaaaaaaaaaaccatacagtgaccaagtgttaaacctggcaactaagtagaaattttcaaaattatgtgggccagacaaatcacatctctcaagtctaaatttagcttttgggtccccagtttgacttcagtcttacagtatataccccctggtttctggcttatgtatttaaaaaacaatcacagtatgattttcttatgattaatttgtaatgtttatacatttcaaaaattcaaactatatggaagtacgtgttttaactacattcaaatcgtcctaatttctgacacacatctatactattcctctcctgtgtctattcactgtacaaaataaagtgcttcacatttacaactttaaaatcaaacaaagagctaactggctaaatcttacctgctctgcctcctcctcctccaataaagggagttccaattttgcttactcatattgaagacacaattctgacctttgaataatttttcccaagcaagggaaaaagcaaactgttttgaactctttttgctttaataactccctagacaactttgggtatatcattagctttctatttctttctttcttttttgagacagggtctcactttgtcgcccaggctggagtgcagtggtgtgatcacagctactgcagccttgacctcctggactcaggtgatcctcccacctcagcctccagagtagatgagaccacaagcatgtgccaccacactcagcttatttttgtttgtttgttgttttttttttttttgagacgggattttgccatgttgcccaggctggtctcgaactcctgagctcaagcaatctcccaacctcagcctccaagtgttgggattacagaaatgagcaagcacacccagcctatttctcatcttctacagttttagatacatgaattaagcgtaaccagtaaaaatttcaagaaaacctctttgatttctttggatgctaaagggtcctattatgagaaatcacttggtagaatctctctccatcgctacagtaagtccttttcccatatatgggaaagtaatcctcaggcccttggttagtcaaacttttgtgttcttaaaatcatttaaaatcaatgctcagattcatgtatgtaaaacgacagatgatgaggaaaataacttgtggacaaaaatggtctaaatgaattaaaaggccagggttgaaagaagattaactataatcttacagtctaacaagcttgctttacttataaaacagatactaagccaaattcagcattatgaacataaaaaaactctaaacttctggaatgaataaacatctttttcactagggaagtcacaattacaaaactttcaacttacctaacctctgagaaaattcgtaaaatttctttaatttgcctactagtggaacaactgcaccccatgccttctcttgcaacttctcatctgctggatgctggattgccttcaaaatccaaagaataaaaatagttagagttaaaaaaaaaaaaaggttcatttttacattaaaatgtaggctttagcaaacataggaaacactggtataatccataaaatatagaatattgaatctaggagtgttgaatatttttttttttgagagagcgtctcactctgttgcccaggctgaagtgcagtggcgtgatctcggctctctacaacctctgcctcccaggttcaagtgattctcctgcctcagcctcccaagtagctgggactacaggcacgcgccaccacacccagctgaatttttttatttttagtagagatggggtttcgccatgttggccaggctggtctcgaactcctgacctcaggtgatccacccaccttggcctcccaaagtgctgggattataggcgtgagccaccacgcacggctgagtgttgaatattctatattgagtgctaagggtgagtcttctcaactccacagacactccataggagtgctaagagtgggtcttctcagctccatagatacttcaaccttagttagatacataactaacataatacattcttagttatccttgcaatagatatgaacataatgaaaatttaaaaatgatccaatatgtttgttaaatattttatgccttggtgcccagcagatccacaaaaaaaaatattgcatatgtttcccatatcacagagtctcttagtatttctttgtcaaagaattattttagcagtagaaaagaaaactcaaaaagtaagacaataagatgccaactctgggaacaggctaagaaatttccaataattaaaattccagggtctaaactagcattaagaaaactacctacgacttaagaacctaaatcaagctgaaactgtgatttaagaattgtcagctgggcgccgtggctcacgcctgtaatcccagcactttgggaggctgaggcaggcggatcacaaggtcaggagttcgagaccagcttgaccaatgtggtgaaaccccgtctctaccaaaaatacaaaaattagtcaggtgtggtggtgtgtgcctgtaatcccagttactcaggaggctgagacaggagaattgcttgaacccgggaagtggaggctgcagtgagccgagatcatgccattgccctctagcctgggtgatagagcgagactctgtcttaaaaaaaaaaaaaagaaaatacaaaaaagaagaattgtcacagatacttattctctataactaaaatcctatcctattctagataataacttttctcaggctttcctgagtaagatgaaaaactagtttcaaatctgaaagggaagaaaatataatctagagatccttaatataaatgacttcttctatacccagtctttcaaatcattaagtaatcttttctgaatagagggttatttccaaaaatacatatttttttgtctttatctttcatttgcccatagatgttttttgtactcctttacagaagttaacatgttcttcaacaacctgatttactttctctaacatcttgaaacaaactaaacataccatctgaaattcagaactaaagcagggacctgcttataaacactaccaagaggttatatgacatgtctcaatactcccaaggcactagtattctgactccatccacacaaaaaacaaaaattcaggaaagcaaaataaaattgaacccagacagatctaacggatgctctgaacaaattagctgcaaactgaattaatgggctatatactggttaagcaatttactttacaagcttggcaccattttcaaattgatgttttattcaatatttttaaatgatgcttaaacccattagaagcctgaagtcaatcctacttatgtcattaatctagaaatattgtaacattgaagaaaatctgacattacaacatgtaacaatcctttgttcacattctatagtaatgagaacatctcaaagagaccttgatatgctgatatagatgaaaaaaaatcctttggccgcaggcccagacttggtaatgatttctatcaggtagtaaaaatttgtttcttgtatttgttattcagcagacaagtaaataagcctttctgtctggtggcagccatcaaataagccaagatgggtacacacaagtccatccaggaggcatggaggaagaagtagtttgatgtagtgtgctttcactgatggcagtaccatcagctctcttctctccacagagatcctggccccacccagcccaataaagtgtgcagactaggccacacaaggttatgtcatatataggatttgtgtgtactgtggcggctgaaaatgcccagttcctaagggtgcaatgtatgggtagcctgtcctttatggtggtaatctgctgaagtttgctcaaagccttcggtacattgctaaggagtgagctggacaccactgtggggccgcgtcctgaattcttactgggttggtgaagattccacgtacacatttttgaggttttcctcattgatcaattccataaagctatagaagaagtcctgacacccaacagatcaccataccagtctataagcacagggtgatgcgtgggctgacatctgccagctgaaagagcaatggcttggatggtccctaaattccacaaaactatgtctggttcttgccatgcagcttggagaaggtagaatgctctccagctccaccttcaccactaatatatgtttgtataattaatatctaataaacaatttaggatagttatgtctgtttacaggtgttacttttcaaaaacagtctgcagattatttcatgaatgctttgtcaaatcatagaacttaaagtgatagtatgtcttctttctagtaagataaactttggagttacatgtcaagtgtttaaaacatgctgtgtggtgcaggaggtttaaaataaattctttaactagctctgcagatttgtctggtgcatgtgattaatcttacagctttattggggtgatggcaacactgtgctggtttactttcaagtggctgggttcagcaagtacaaacttttttagttttgctttagacatttgcagagtgggagaaggataccttaaccctatgtcgtgatcatacgtagaaaaacatggactcaaatagaatccacatttttgaatttaatctattgtttcatttgtatgactcctgcttctgagagaaaagtttccaaaaatgccatcatttctcagaataataaacgtgttgcaagaggcttttcttaggaatgaaacaaatctgggttaacctaaacaaaactgcctcagtctccacagtagcattttaagttcacataaaagttccaatgccatagctctatagaaatcaatggatagtagtcagtaaggctatttacactggcgtattgtgaaactgaatgttatataaatatgaattattaaccttaacttttacaaactactaatcaatgctaggatgggaagccagtaagctttagataaatacctttcaagtgtgagggtagaaaaagtcaactttgatcaagtttttaaaatatttatcagtaacactaatttgtgaccattatgaatcccttcagccacatcggggaaaatagttggctattcagaagcatgtacatcattcttagaccagttagccttacaaataaaaacatcttgagccaacccactctgtccacactcacaggctacagagaaaagtcataattgaagccagtataagttcctggtttccaatctaaccgtatgtgttgtgtgcagttatttttcttgtccctgctcaaactaccctaaaatccttatcattcaacaaagctggaacatcaggtatgtgccaacatttacataccaccacaatgcattgcatttgtttttatcacgtttttccatagacgaggctactgtctaccagggtaaatttgagtgtgaaggaaatgcagaaaaggaattgcacaattcttctcaattctggatttgctggctttaatttaaatactggtttctatggactaatttttctcctatcttctctatgggattcaaaaggcttggttaactgatttccagggaatattcatagaaagttcacagaagttcttgagatctaaattcctttctactaaaaaaaaaaataataataacttaaatcacacattttgactgtatatagagattgttcaactaaaggaataaatgtctattaaactaaaaacagtaacaacaacaaaaaagcaaatagacaaaagttaaaattttattttcttctcttaaagaagtcgatcctattttcttgcaaggatctaaaaatgcttttctaaatatcaattcattctcacaatataaaaatgctctagcaaatgtcacccattttcataactggacagagataaccatttccctgcccctgccttgcctagatttagaactgaagacactggctgctctcttataataaacattttatggttcttccttatacttctaattccttgtcctctcacaataatttactctgtttgataaggttttgggtcaacacccattatagcccaacatgcaaaagggcacttagtaaacgtcaatggtgaggttattacagagcaggtataacttattttcaaaaatattaaactggctgggcacactggctcacgcctgtaatcctagcactttgggacgctgagacagaaggatcgcttgaggccaggagttcaagaccagtctcggcaacacagcaagtctgtctctctgtctctattgatttattttgatggagtttcactcttgttgcccaggctggagtgcaatggtgcaatctcagctcactgtaacctccaccacccaggtacaagtgattctcttgtctcagactcccaagtagctcgaattacaggcatgtgccaccacacctggctttttttttttttttttagtagagatgcggttttactatgttaatcaggctggtcttgaacccctgatctcaggtgatacacctgtcttggcctcccaaagtgctaggattacagggtgtgtgccaccaatttggctatttatttttttaaaatttacaaaaaaaaagttaaaatggttagggacatattacattaatggaaagtacttatttccctctaggtggttaatcctagacaataagcattgtttatttaatagattctatcttaaatcaaattttattctatttaataatgtttaaaaaattatttaaagtaaaatatattaatatataattcaacattattagtacagtgataataagaaaactctcagttcattttagctgtgtatcagacacggtgctatgctgtttacatggattgtctaattttatcttcataataacgctgtgaattgcttccacatttttgctactatgaataaggcggccataccagtttttacattgacatttcctcttaaactagttgtttgcaatgttttataaaatataagtacctggtgcaagagcacaaacaattttatagtttttttttaaatatacttcaaactgacctccaaaaagactacccattttacaatacttcttgcactaactgagattactgtttcttcacaaaccaaccaaaacttcttcacagtgatgtgcacttactagcaaagctgaccattttttctgttgtctgtgcttttttataggtagaatagttggctgctctaagtcttattaattaacactattagcaatttaattattgacctatgactcttgtaacacatcagttatttgtatatttggtgtatattcatcttttatttgtacattcctttcttaatttgtttctctactcttcagaaatcttttctctttgtatcattaaacctgcatcaacttctcaacaaaaatttcaactgcttcaatagttacatatttgtccccgatctacagtagatttaaatgcagcttttccgttttttagcttacatattttgtatttcaatgcctatttctcttttattacttatcaatgtttaacaatggtacctttataagttgtttcaagcctggtaagatgaattacttaccattgctttttacttttcccttatattttggtgttcttcaatgttatttttctatgtaaactttctcttttcttttaaacttggagacacttacttactttctcacatcaccaatcatggactatttttgagtgaactatgcgtggctatgtcttgtatttcctcaggaaaacagcactactgagtgactacggtatcctatgcaaaacttcaatctttggtcatagcattacgagatcctggtttcccagccccagaaagtctctttgatatatcctatatataaacttttctaccactatactctattccaaaagattacaaatgaatcttaatatgcatccaatcaaatatataaacagactttagagaaaacactattattattttattgtagaaagccttcccacacacagaagcagaataattctcccaatgggaagtactgcaattaaaaaaaaaaaaaaaaaaaacccgggctgggcacagtggctcatacctataatcctagcactttgggaggctgaggcgggaggactgcttgaggccaagagttcaagaccaacttggccaacagagcgaaaccccattaaaaaaaagcctaagagttctatatttaaaaaaaaaaaaaaagaagaaaaaaaaataaagaagaaagaaaaaaaggctgggcgcggtggttcacgcctgtaatcccagcactttgggaggcggaggtgggtggatcacatgaggtcaggagtttgagaccagcctggccaacatggtgaaagcccatctctactaaaaatacaaaaattagctgggcatggtggtgcatgcctgtaatcccagctactcgggaggctgaggcagaattgcttgaacctgggaggtggaggttgctgagccgagattgtgccactgcactccagcctgggtgacaagagtaaaactctgcctcaaaaaaaaaaaaaaaaaaaaaaatcaaacaggtaatgaatagtgtttgtctctatagcgagtaagatttttctcttcataacaacaagctttaaagaagtttaatgacctaacacttataaacaatttaaactaatttgtagcactgataaccatcataaaaaattttaccaattaattaagatcctactaaatcatttaaatctttcacttccacaaatgtttgatttttcaaaatacgtttaaatgtttagagaacttgaatttcacagaaatgcttatatgccttagttactgaaatcttaaggttttacttaagccaataacaatgccaagaccaaagcccttgtatttatttgttcaacagctaaccgcttactaagtgctgtaagtttacaatgtactaggtgctgataataacaaaatatataagaaaccaggtttaccttcctcaagctggaagtacagtggtacagagataaacactcaatagtaatgttttacctcccccccgcccaaaaaaaggaatggttcccacaaaagaaatgtgtataatgtgggcaaaagagtaagaggaagtaggagattatgggggggtggggggagggggggcgttgaagaaaaaaatgaaaggaaggtcattccagacaaaaacaaaggaagggtgcatatcaacaaacagaattcacaccagaatttccctcagttaatgacactacgatctgctaatgtaaaataaaaacaagggccaggcatggtggctcatgcctgtaattccaacactttgggaggccaaagcaggttggggcggggcgggggatcacttgaggccaggagttcaagaccagcctcggcaacatggcaaaccctgcctctatttggcaggggatcagccaggcatggtggtgagtgccagctacttgggcgactgaggcaagacgatcacttgagcccagcaggttgaggctgtagtgagctgtggttgcaccactgcactccggcagggtgacggagctaaaccctgtctcaaaataaaataaacaccatggaatcatttaactctctctcttcccttgccctaaacatttggtcaatcaccaacacatgttttgaatcaccaccttctggtgtctgcacttgattctgccttcactagtactccaatgtcagaagagaaatcaaggtggatatggaatgtatgccccatatggaatgtatgccccaaagagtgaccctgatgacctctgcactctttgttatagacaataataaacaaaacagaggatgggaagaatcaagaaacacagcacgggcaatggcttcaagaaatgcagtaatgagaaggggagagatgaaggcccaggggacagggagttcctctgtgtagttctggacacctaaacatggatatgctacggggaagaattcagtaaaagaaaaaagatagaagatttaattaagagaagaagaaataattaaaagagtaaagtttcagaacaggatgaagaacaaaggtaaagaagtcagtcttggaaagaagcaaggacacagcttcttctgaaaaacaaaagaaacaaaaaatgagatgaatgcaaacctgaaaaagttcagcagtttgggagaggaaagttgagggagaccacactacatattttctttgtgatgtaaagtcatggggaaggtgtactgactgcaaggatgatttccactttctcctaggaagcaccacataaatactgcaaatttcaggtataagagcaacccaaaaagtaaataacattttcttaatttacaaaaactacctatttatggaacacagtttttccttttatgctcatttcactgcaatcacttctgaaacaatgccaagtgagcatccttcaaatataatacttaatatgaaatatagaattctgaagtctagaaaacaagagattacaaagaggtgggacagtaagtttcagttaactagaaaatacataaatgcgctttacctctcgtatttcgtggccagctcctctgtatgactgcaagtcctccaagatgccttctgcatcttttaatactacattcacctgattataaatttccttctcagactctgtaggctgggcatctaaacagcaggaaagcacaagaaaatttacagtgacatgaattttttaaaatacatgtgtaactctaagcaattaacaacccaaatttccaaagatgagttaattctagttaatgttaactttgaacttttaaagaaaagactaatactttttccatagtcctacatttaaatgactagtttcaagtacatagatattacagaaaacaagggaacaccaaacattattaacttagtttaagttccaaattaggacttggtatattaaaccaatctgagaattataattaaaatttttaattgtgatagttttaacaatcactttttctactacattcatcactatcactgtaaatgcatcagaaatcacagattttaatgcaaaagaaagcctactaaaacatgttgctcatgtatagtttaagacaaactatttttattttcctataaagttcattttacttttaatgactgagttttgatataaaaaagtaaaaaaactttaatagtttttaggtgctcacccccttttccaggaatcacttcgaaagtgtctcaacatatatgatattataggttaaagaagagaggatatatatatctaacaacaaacccaagagagtatcactgaactattctgctgatgaacagaaggtcaagaatcctgtgcagaggatttcaagttataaaactgctccacaattactcagctgctgaaaactagatactttaagctacactacaatactactactgaaattttgaaatactaaagaaaatctgagttcctacacacttgggagtaagagaaaaatgaaggaagaattacagttataaaaagcagaatcaaggacacaaacatatgggcattttcaccacctgtggtgttagccacaaaacatatgttaatgaatgactaaatctggatttctctctgcttgactcaagttaacagaaatcttgcttttaataatactggtcatttgtttctctaaggacaaatcttttatattttaaggaaaaaggtggactctaagaggaaatgaaggtttctttacaaatctttccaactaggccacattcagcaccacaggtaaggcataaagcacttaaaatcataaacattatgattatcatattttagagaaaaatgactggcagaattcctccatgctaaaattttctcttatgagggaaaaggaatcagtccaaatttataagatgaagtaagaacgtttttaatactatcacactggtcttttaagtttaaaaatattttaacaaacaagaaggtttttggtaaatctttgtctaccaatcatataaaattagttaactagacttttctgctccttttcacctcaccacaaatacacaatgatttctttattcctttacttagaacattgtaaagaaactttgtttacacgtgaaactgggagtaaagatccctaaaaacggtaacgttattttgtgcttggagcaagtcataattcaattctacctaataaacctgccaaatagtcaaaaatataccacattttttttaaaattcaataattacattaccaaattttaaactcaacatatgtaaaacagtactacagcaacaataaagtaacattcatatgtaaagtcaacttaagaatgtgtttacatatctgttcccttatttttcaaatttcttttcagaaatcattttttaggaggaaaatactgtgacaaaataattatacaagaggagccaattgaaaaattaaaaagactctctatccaaggctacaaaggtattatcactaggaacaaatactgatattgcaactaaatggttagctttcttatagatcaagctttgctatttagcagtaataatttactgctaaatattttacatttagccagaccatattttccaatgtaatagtcagacatacactctttttaaaaaagcacacttcataacttttatacttacatcagattcagtagagaaaaatatgttttacatgcaaaaaacgacagtcttacactttttcatatggaattgtgaaactacagacataacatcaatagtagacacgtatttagtttgaattcatgaagtgggaattcatgacaaaggacaatagtttagctattatatatcaaaggtatctgtgaagtttgaaaatgctagactatgtattttaggtgtggtgactagctgttaacataaaaatgtgacactgagacttaacatacaaacgaaacattatcaagtagacttaagtagaccttgtaagtggttaataactagtaaaggtttaataagtaccaagaaatttaaaaatagaggagaagatttaagtttccctttagggtgagaaaaacacccagcaccacaatgattaaacattttttagactgtcacaggaaagtcacatttataattttgaaagctgctgaagactgctatagaaatgaagacaaacagaaaatagcagacaagtaagcactactttactgaaagcaagtcatgcaaaagggtgaaatactaggaagggggaaaagctgtataaaacaaagctttttattttatttttttcaaaaaacggtactatataatgcaaccaagacttgtcactttgattttccatagaaaaaaatggctttactatttaaaaaaaaagtaccatttagtcagcttacaaaaggacatgcaaaattgcaaaataatgtatctactactgagggtagacatattcattactcatcaagcttagtttttaaagctgttcaagggaaattaaggcatgtttcaattgttcttattgaaggtaaattaaaaattttattaacttcacactaatttcttatagggtggagggtagaaaaagagtcaatataactgctaaaattgaagtcgttgtaatataaaaagaagcaaagattaactatgaaatgaaaaaataaaaagtcaagataaaaattataattgtgataaggggtctttctgctttaattttacattaattcacttaataaacctacgcaatctatctctgtaagttacatcaagacagagaccagaatgtacagtatgtaccactggtacatctgtaaactcagtacctagattttctgtaatacattttgaatgaatgagagggtacagagacataaataagcctctggcatgaattaaaggagactactatgctttttgatctctgaataactatgatcctatatcatttttgaaaaataaatataagaaagatgacaccagaataaagatatttcaaagtacagggcaaaaccaactgaaactatgcaagagataaatgaaaaaataagttagagtaggtcccaatatttctaaatgataagggggaaacaagtaacacaaaggacacaagaactatagaggaaatgcatgactcaatggaaaggcactataacagaatcagagaaaatatactctatttctcccttaacaaatgactacctctatttactctcctattttgatttccctggaggtaagtgagtcaagtttaaaaaatacttactgaacttctatcatttaaaaagcactatgctaagattgggaaaggacacaaaactaaatacaagtctcttttctcccaagaactagaatttagtgagctagcagttatggaagttactgaggctaaagatttgtcattagaataagctataaattaacactgttgttataaaataggaaattccaacaactagaagaggctatgcaggcccccattcagtgctttttttttttttcaaagacagtttcactctgctactcaaggtggagtgcagtagagcaaatcacagctcactgcaagggcacacatcactattcccagctaattaaaaaattttttttttcatacagatagagtcttgccatgttgcccagactggtctcaaattccttgaatcaagtgatccttttgctgtggcctcccaaagtgctggaattacagccatgagccactgcacctagctcgattgagtgctttttatatgctgtcaatagcataactgctgccaaattttatggagcaattttgggcttatattttaactgaactattattaaataaaaacaaaataaaatcttatcatataggtgtaatctgttctaaggaaaaaatccttctatcaagactaaacgtctaactgaatacagaatgacatttcatgccttaaggtctctgtccatgttgttccttctttctactgtcctttactgtattagttcaaaacattctaattcactctccaaaacccaattcaaacatcaccatcagaaagtcttccatgatgggccaggtgtggtggcccacacctgtaatcccagcactttgggaggctgaggcaggtggatcacctgaggtcaggagttttagaccagcctggccaacatggtgaaaccccatctctactaaaaataaaaaaattagctgggtgtggtgctgcatgcctgtaatcccagctactcgggaggctgaggtaggagaatcacttgaacccagaagtggagaatgcagtgagccaagatcatgccattgcactccagcttgggtgacggagtgagactccatctcaagaaaaaaaaaaaaaggtcttccatgatgattctcaatctactccctgccatttaaagttagtatcttcatgagctacacgttgaaaataaataatttaagtaaaactgagttttctggcaggtgggcacctgtaattccagctacttttgggtactgaggtgaaagggtcacttcagcctgggaggtcaaagctgcagtgagctgagatcatgccgctgcactccagcctgggcgacagagactgaccctgtctcaaaaacaaaacaaaacaaaattatgagctttcgtgtctatcctctcctactagattgagagcttccagcatgtatgggttgtatcttagttattttgcaaccccagcacctactggctggtatacaggaggcaaggcataaatgtatgttgaactgaagtgaaaaacagttacaggggtcatgagaggagtaaattaaaggaataatgatttactttaaagacaatcttaattttgtaaactacaagattccattaaattacatttcaaatgcactagagtatgtcatttgtatataatatgatacaaatagcgaggtaatctgcatgaattatttctgtagtcacccaactgcagagacatattgggtcacccaactgcagagacatattgggtcacccaactgcagagacatattgggatagacttaatcaatcagattaataaaacagtaaaactaaattactctggtgacatgaatattaaagtgcatctagaaataaacaatgtagtactaattactctagcaaaaataatgtggctttaagttattgagaattagcagataactatgttggcaattttgagtctggtataaagcagtataaaacggtttaagagaacacccatctgataggccaaggtcaccatagtagcttataaggtaagcttttacaaacgcatatttccaaaaagaagaaaaatatacagagattaaattaagataatgccaatgttagaatcaaaagacaatgtatctaaaaatctaaataagaaataacaatgggtaaactctagtttggtatacagtatgctgtcactaaatttcatttatagtataccagtaagtataaaaccagaagatctacattggctgatataggcaacaatatctgcctttacagttaacattttatatgtatttctgcattattggttattattgttgcttgcaatttttaccttttcctgtcactattattaaattataataatgtaccaggtgcagtagctcacacctgtaatcccagcactttggaaggccaaggtgggtggatcacttgagctcaggagtttgagaccagcctgggcaacagagtgaaaccccatctctaccaaaaatatgaaaaattagctgggcttggtggcatgtgcctgtagtcccagctactctggaggctgaggtgggaggatcccttgagccaggtaggcagaggttgcagtgagctaagattgcgccactgcactctagtctgggtgacagggtaagacctcatatcaaaaaaaaaaaaaaggtgtgtgtgtgtgtgtgtgtgtgtgtgtgtgtgtataaaatgatccaaacactcccacagattggaaagccaagaccaagtaatcttttaaatactacatttaaattcatgcttcccacttgaccataacataatactaggtttacaaaaagatcaagtgccaagtcttgaacaagatcttgactatcaaagtcaagattctgtaaatgtaaggaatttgagacaaagaggaaaagggagacagaatagcagaaaaagacacaagaccaagtttgaaacagatgcaaataaactaaaatacagctctaatgtaagttgcctcatctgaaagaatatcttcaagtcagcaatctgctcgacatcctcaagctgattaaaagtcatgctaaacatgcacttaacatagcactggtaaattgttgagaagggtcaagaaaactaatattcatctaatatttaacagtatttcccctaaaaacccaatttcccctgaaacccaatttcacatggacctgatattgatttactactctttactagcctgtacacagtacccaaactgtaacagatcctttatagaaatggaataaaagtagaaaataaccagagaccacaaattattctacaaaatggagatagctataaattgatgtgttcatatgaactgccatggtttagaatgattcataaaatagaatgaattacataaaattgtaaaaactaaattgaagttggaggaaaaggcagtgactttctggggtttaagtgatttatttgttttgtttttaaaatcagaaaacatcttaaattttaagtatataaaaatacattctaacacttaaaaatataagggatcacatgattaaaaacctaagaaatacctcttcaccctttcctaacaattttctattgatcagttaaaatagcatcattcacactaaaacaccaatttaataattcttctcaatttaacaaccagacaagctaaagcgatatcaacagccaaaaaaagcaaaagctttgcaacatgcaccaaggtcaatgacacttacctgccactcttagaccatattacaataggtcatgcaacataaaacaaacagaaggcaaattacttaaaggtctgtgaacccattatttttcctttcatttagagtcagaaaaaataaattcctgaaataaatacattctatttttttaacttttcaaattatctgcaaagattaaataatttaggttcacacttaccttttaatattatgcccaaattactgagctctgaatggccttcatgaacagattgatatttgaaatacttaaatatgtaccctacaataactgaaacctggtcgatttttcttgactataatataagttttccccaaatattgcttctattaataaatcttgaggtagtacttgtcctttccaacaaaattttttcataaaaatgttttcattagagaatagatcgtaaattacaaaataatctccaactaagagatatgaaatctcttataaaaactcaaagacattttatcatcacaatttaatctataaaataggacttccagttctagaaggcaccagaaatttactcaaacaattcatagctcagtcatgcaaagcagttaaaaagatggcaaagtggaaacattcatttagtgcaagacaaacgcagtctactgcaggcaaagagaaatagatataaaatcatcttctcactttcaaaatcaaggaaaaaatttggcccctgctcaaggtctgtgcatgtcaaaactttaagaagattccccatgttaaggtacctgtcaagacaagaatgagaaaagagaaaatatccctttataaaaaagaacatctgaagtttacttaaagaaaaatagtaacagggaaaatgttcattaggccatgaattcattcttcaggttacccagactgtgctctggcagacagcaaaacgggttctcaaggtgttgatatgtaggacctagaggtgaaatgtggttttcctgtacacaatggcacaactgttgctctaattcttctcaaaattctcccaagacaagtttcattaatggccttataatgaaaaattctttaagtattccaatagtgctaatattctgaaaaagaaatttctgatcaagaattatttacatgtagtactgttagtatagcactgaaacaacaatttatttcaaagccaaatattaatacatttggccatgtctcacctttgcatctcatcttaaaacagtataaaactttcttcctgcatgcggttcaataaagcatatatttctaaccaaatttggattgtcaataatttgtggaggtacggagactactgattcaaggtatgcagcacaattctgatttttaaaataaaattattacaggattataagcgaatattgtttgacatagtcactaaagcatactattagaatgttcatcataaggctacttgcttcatggactaatgaaaggacagcactggctacacactcaacatgattttagcaaatgaaaaactaaattatacatatgatggtgatgtttgcctacgattaagaaaaaatcatgcaacctttgtttgattcccatgtttaattaacaaatattctggctggccttcactgtggtgagtataattcatctttcacctttaccattatgcaccagctgtgaagggctaaagagacttactttcaaagtccaagaaaaaatgtgctgcattgtggtctatgtccctggttagcaccttaatgagattacccatgccagcaaacctaaaaataaaaatggcaacatcatttagttccagtaaaaaattttaagcagaggcctgggatttggcaaaggctggcttgctcataattatcaacaggtgcaggtttatatgcttttggcattgagaatttggaacaacaaaagcacatttggctctgagtttatagctcctgtccctcttttccacatatcaaaaaagttacataaagcaagatgggaaaaaagattagattttgacatataacttgcaatatttacattttattactatctatgttagtgttactcctttaaaatttttgaggcatatatttctcaatttaacagcaaaactagatttctcaaataagtaactatagaaaccatttttttaaataatagggatattttccttcttgcagagtcaaatcctattgggaacacaaagaagaaagtattcaaaccacatttaaccattaaagcctaaagaaagttatcaattaatgacccatctaaaaaaactttaccacacataaaatgtttttgatatcttctgtctcctaagattaatcaaacttattatttaactcttagactgaataatcaactatacacaactataccatgtatggaacttaaaagttaacacagcaaacagggagccagcaattatcacaacttagtaggtttgcggaggacaaaaagtgaaaatacggcattggcataaatgttgcccaagatttccataatgcagtgaggatgaaagtgggaaatggggtcagaaacatccaggaaaccaggttcaaacctggaaggtagagtaacaaaaggggaggcaaactatggtatcacggctacccacatcctcctccctccaactgctgtacttttcctccaattgctatgtgtttttctccaaagatcccgttgctggcaaatgtaaataaggcaaaacataaaacaatatttttattaagaaaaaagacaacttgccactcactctcattataagaagcttgaaaaaagttagcacttcccgtcacctgtggcatccccctcttccacctactctccaacatcagcatatgtttctaactgtaagcttcccatgaggaaatacaaatagctatttgctttagaggtcaaagtctgatgtacggaaacacaaatttcttataaaatgttaaaagcaatccaatttattcatatatggtaagtactgaatggttcttcccttttgaaacaatattcccccaatgggggaggtggagatctatcttcttcttatattaacatttctattacacagaatttcaatggtctgattttgtacaatactttacacaagtggattaggtgacattaagctaagagggaaatatttaatattttgacttaattactgtatacattgtaaaacatttaataataccaagcttttatattaaaggaaaagataaacatttttcctaaatcatcacacccaaataattatctcaaattggttactaaagttcttcaatagatgttggaagaaaccatttggaaatagcatatttcacagctttaatttttaaaagctttccaacatatatggaatgactgtatccaaacatatataaattttctcactaacaagaactgagaccaaatacacaaaaaattacctagtggtatcaaaattggaactacagatgaaaaatatatcatgagaaaggactataattattttcagtaggaaaaaggcagcacaccatttggttttaggagtttaatctatggaatcaaaccagaaattcgactctagcttactagctgtttgaccttaaggatggtagttaacccttttggggactcatttcttgattggtaaaacacaggtaattatagtaaatatcttaaattcctattatgagggttaaattagattaagcactgactcagtgtctggcacacagaaaacatttaataaatattggctgttgctgtaattaaaacctaaatatcacaaaataaccttttaaaagtaataatggctctatttcttttaacataaacctgagtccttatcaacacattccaatgttataaatcagaatgaagcccatatttatcaagaatattgctgaaatgtcctaaaattagttctattaacatcatcaggtatgcatggagaagagggagattaggtttccttacctttttacgtgtatgcacacagtccaaccttggggaaaattttggaactagccatgtacgtctgctccattttcctacagctcgttctgtaaacttcttcctctgtatatggttcttctttccaggcacccgaggctaatgtgatcctcccctcctcatacttgggagtatgaccactaccatcagacttggtcctgacctatttgctctcataaggattgagaatttcttgcttatttatcccatacacaaacacttagtttgaaaatggctcagttggctgggcgcagtggctcacgcttgtaatcccagcactttgggatgccaaggtgggtagatcacaaggtcaggagttcgagaccagtctggccaacacagtgaaaccccgtctctactaaaggaggcggcagttgtagggagccaagatcacgccactgcacactccagcctaggcaacagagctagactccctctcaaaaaaaaaaaaaaaaaaaaaaaaaaaaggaattggctcagtttatctaacacagtgtttctcagtctcagcactactaacattttgggctgaggagttcttttgttattggagtctgtctcacattgtaggaaatacaccaacatcttgggcttcaatccactagatactagcagctaccccccatacaagctgtgacaatcaaaaatgtctctagataccgccaaatatctcctgggggcaaaatcacccgactgagaatcactacaactgttgtccagcgcaaaaattcgctctaccacatagcacacaggacagatgctacataggcagctcatatcacaatgtctctttgaacaaaaactcatggaagttttcaaagctctaaaaacagtcccattataacattatcggttctcctatcctttataagaataaacaaaaaattaaaaccataaccctatcttgctatattttaacctggccaaaaaccaaacaaacaaacaaacaaaaaaaacccctgctgtcctctcactgtgactgttttcaactaatataacagtggttaatcatcagcttaggtgggaccagactgcctgggtctgaaacccagctgtgccacttccaaactttgtgacttcagtcaagtgttttttaacttctccattcctcagttttctcatgtgtaaaaggtgcatattaataatatccacctcagagggttcctaaaatcattaaatgggttaataataagcaccacatttagtgccatacctggcagtttatttactattactgttgcagctgtcagagcaacctaactaggggctctgttcccagcagcagaacttatggaatgtgaggcgtgggcggatgtggcagtcatacttcctgccctagaggatggcagtctatcacaagagaatgaaccaatattacagtgcaaggtctcaaagagtgtcctggagtcattaatttccttccattcattcccgagttccagctgtcacttctctcagtccagctgcttgattttcctctggttttaagataccctagtttttttaaactaataccccttttagctgttgagttggatttctgccatctaaaggagactagtaagatttctaagtttcggatgaataaatacatttgatatgaaagataccaaaggatttaagattttttttgagacggggtttcactcttgttgcccagactggagtgcaatggtacaatctcggctcactgcaaccttcgcctcccaggttcaagtgattctcctgcctcagcctcctgagtagctgggattacaggcatgcaccaccacgcccggctaattttgtatttttagtagagacagggtttctccatcttggtcaggctggtctcaaactcccaaccgcaggtgacctacccgcctcagcctcccaaagtgctaggattacaggcgtgagccaccaggcccggccggatttaagattttaaagcagacccaaaacactattgatatattttagaggtaacaaatattatcatttagaataataaactaagtcttactatctgaatttagaagggaaaagctaaagaatcttctttcaaattattttctatcgtaatccttggatttaaactaaatattgtatttactaaataagctaaaaataaatttaacacagatttaatacacagaaaccagacatggtttacctcaggagttgtcctatttctggtggaattttttttactatgagcccttacattagacatttgtttccacgttgacaacttatctggaaaggaacacgcccttcctggccggtagtctgtggaatgtatttttaagctaacaaaaggcacttaaatacattagaccattttcccataaaacatttgaaaagaagtttccttacagaataatagccaatagaaacaactataccctacaattactataatatttcctctatctttctagaagcttcctaagagatgctgttacttcacttactttttctcctcaaggtactttttaattttgtctcctcttcctagaatgctagtcccaaagattttcccatgactggcttctttccatccttcagggctcatcttaaaaggcatctctttgaagaggcctttctctgccaaccttctcaaaggagttgcaccggttgcaacttctagtgataatcttctacctacctcttcactcaacttatttcttaagcatatttatcacaatctgaatttctcttgtttagtgtcagttttcctcacatccagcttataaacgtattaaagacttgtgactggccagtgagaaggaaggggaagaaagaaaagtaacaaacacactaaccagcttcactttaaatcagggtttcttaaactcagcaatactaacatttgaactgtacaattctttgctgtaggggactgtctagtgccttgtaggttgtttagcagtattctgggcctctgcccactagataccccttatcacctctgctcccagctgtgacaaccaataacgcctccagacactgtcaaatgtcccctaggaggcaaaactgcctgttgttgaaagctgctgcttttaacatatgaccaccaacctgaagtgcagcctcagttttgctacctcactcaatctcctctcccactttcccaggtgattattccacacattaaaaaaaattcttacctttctcatgatctcttaaaaaaaaaagaagaagaaaaccacaaaaacccaacaacccatcctccattctcacttgcaggaaatgacctcactgtatctttcacacacaaaacacataagcatctatcttttctaccatcctttcttcagtaaccatacacccaccctctgtacctgttttcctgaaggacaacctttcttctggggcactacttctcctgcctgcttttgtctcctcaaggacttcatgtgccctctactacaacatcatctttcctgtcctctttatagcaagacttgtcaaatgaactgtctgtagctgtttctttccacctttcaaactccgattctttcaactcattccagtttggcttttatgcccactacaataaacctgtgcctgtcaaggtcaccaaaacttgcatttggctaaatctaaaggacaattctcacacttcaacttactgaactagcagctcttgacccagttatcacccacgccttcctgaaaacactttcttcaaaatttgacattctgaacaatacattatcttgagtttccttcctacttcagtttttctttttcagtacccttctgtttggcataaatacatttatttcttccatcttaaaacataaacagaaatgtaccttgattctatttccctcaccagctcccaccctattcccttgcttctctttgcagcaaaattccttaaaaggaataatctaacactcagcatcttttgtttctctcctttcgttctctattaaacccactgcaatgtggcttttatccccatcccacaccaccaaaactgcactgggaaggccatcaggtaacttccacgttgctaattccagtgtcaatactcagccctcacaccttaccttgcctgccaggagcatctgccctgacactcccctcatcctcctcaacacacttttatcattagcttaaagggcagcacgtctcacctcccccactgccacacctccctacttcttgctaccctcacttcctgctagggttgctggtctccctgtttccaacccagcctcctcctacaatctcttccacatataagaggcaaagcactcttttaaacatataaatcatcctttctctgctcaaagccatgcaatgactcactaacacactcaaaataaaatccaaattctttaccaggttgatatgatttgaatttgtgtctccgcccaaattcaatgacaaatcaaagacaatggggaaaatgccttgaaggcatctcagagacctttgtggcagcccctcccaccacagactcagaggccaagaggggaagaatggtttcacaggccaggcccagggcctggctgccctggggacactgctccctgcatcccagccactccagctccagccacggctaaaacagtcctagattatgtctcaagctgctgttcaggcaagtagaagccataagccttggcagctttgatgggtgttaggcctgcaggtgtgcagacagcaagaattgttgaggcttgggagtctctgcctagatttcagaggatgtatggacatgcctggatgttcaggcagaaggtacactgcaggggcagagccctcatggagaacctctactaggacagtgcactggggaaatgtagggttggagtcctcactgaggcactgcctaacatagctgcgagaagggggccaccatgctccagaccccggaatggcagatccaccaacagcttgcaccatgcacctggaaaagccacactcaatgccagcccttgagagcagccatgggaggtaagccctgcagagcaagaggggcagagctgcaaaaggcattaggagcccaccccttacatcagtgtggcctggatatgagacacggagtcaaaggagattattttggagctttaagattgaacaactgccctgctaggtttcagatgtgtatcaggcttaaagcccctttgttttggcctattctgcccttttggaaggggagtatttaaacaatgcctgtaccctcattgtatcttggaagtaactaacttcattttgattttaaagactcataggtggaagggacttgtctcatctcaggtgagactttggactgtggacttctgagttaatgctgaaatgagttaagacttgagggactgctgagaagggctgattatattttgcaatgtgagaaggtcatgagatttgggaggggccaggaacagaatgatatggtttgaatttgtgtccctgcccaaatttcatgagtgttggagaaggagcctgctgggaggagactggatcatgggagtggacttcccccttgctgctgttgtgatagtgagttctcatgagatctggttcttttaaagggtggggcacttccccatctctcttcctcctgctctggccatgtaagacgtgccaccttcctcttcgccttccgccattcaaggtttcctgagaccttcccagccatgcttcctgtacagcttgcagaaccatgagtcaatcaaacctcttttctttagaaattacccagtctcaggtagttcttcatagcaatgtgagaacagactaaaacagaggtcccacaaaatcttacacaatctgctccgacacactctggcctcatctttctttactctccactgcacacatgcgcatctaaccacaaaagcctgcttgcagtttctgctgctcagtaaggcctcacctcttcagagagaatccttgagctacctacccacctataaatgccccttccatcctcctctctatccccttcccaaactgatggttcgtaccatctaacacacattcctgttactcttatctatttactctgtcttcctctgagtaggcaggggttttgttttgtacactactctatcctgagcacttagaacaatgcctgggatgtagttggtattcattaagtatttgctgaaaaaatacatgattaaaaatagagaggccaggtacagtggttcatgcctgtaatcccagcactttgggaggccgaggtgggcggatcacctgaagtcaggagtttgagaccagcctggccaacatggtgaaaccccatctctactaaaaatacaaaaattagctgggcagggtggcaggcgcctgtaatcacagctactcaggaggctgaggcaggagaactgcttgaagtaggaggcagaggttgcagtgagccaagatcgcaccactgcactccatgggcaacagagctagactttgtctcaaaataaaaataaaaataaaatcctaggacccttaagaattatactacatccactctgcctgtgctctctaaatggtacaacaaagcctagatgacagcatatctgtttacagcatggtgtactcaatattctaagcccaccattgagccctattcctcagaaaaaaaatattcgtttcaataaattactgctcactgataatgcacctagtcaatcaagaactctaatggaaatgtgtaaggagattaacgctgttttcatgctgctaacacaatatccactctgcagctcatggatcacaaagtaattctggctcttaagtcttattatttaagaaatacatttcttaaagctaaacctgtcatagatatggattcttctgatggatctgagaaagtaaattgaaagccttctggaaaggattcaccattctggataccgttaagaacctttgtgattcatgggaaggggtcaaacatcaataggagtttgaaagaagttgattctaactctcacagatgactgtgaggggggttcaagacttcagtggagaaatggcagatgtggtggaaataccaagagaactagagtagaagttcatcttagaagggcctttaagatgtgactgaatagctgcaatcttatgataaaaacttgagtggatgaggagttgcttcttatggataatcaaagaaaatggtttctttcctttttttttttttcttttgagacagagtttccaccttgtcatcttggctcactgcaacctcagctctcgggttcaagcaattctcgtgcctcaacctactgagtagctgagactacaggcacaagccatcacagccagctgattttttgtattttagtagagatagggtttcaccataatgcccaggctggtctcaaactcctgagctcaggcaatccacccacctcggactcccaaagtgctaggattacaggcgcgagccattactcccagccgaaaatggtttcttgagatgaaatctactctggtgaagatgttgtttagactgttaaaatgagtatcacatgaacacagctgataagcactggcaaggtctgaaagtactgcttccaattttgaaagttatactgtgggtgaaatgttacccaacagtatcatatgctacagagaaatctttcatggaagtgtcaactgatgtggcaaacttcatttttgtcttattttaagaaattgcacagccacccaaccttcagcaactactaccttgatcagtctgaagccattaacatccaggcaagaccctccactagcaaaaaggttaagacctgctaaatgaaggctcagataagtgtcagcatttttatcaataaagtatttttaaattaaggtatatacactgttttttagacataaatcgtatcaataatctcagtaacccttctgaaaatattcaaggcaccaccctcatcaaatattgcccgaagtctgcttattgaacggcttctaagaaactgtaccatcacttgaaagcaggccaggcgtggtggctcacatctgtaatcccagcactttgggaggccaaggtggggagattacttgaggtcaggagtttgagaccagcctggccaacatggcaaaactccgcctctactaaaaatacaaaaattagccaggcgtggtggcacgtacctgtagtcccaactactcaggaggctgtggcatgagaattttttgaacacgggaggcggaggctgcagtgagtcaagattgcaccactgcactctacactctgcaacagagtgagaatgtcccaaaaaagataaaatttaaaaaaaaaaagaaaaaataaaagaagaaaagagaagagaagagaaagcaagcaatgtcaccaaaaggaaatgaaaaggtgggaagaagaaaaacaaagggatctttcaagtcctgtcataatttcttccagcagtaagacagctagggttccaagctctagcttcttgtggaactcccagcagcagtgcattatctggcccccttcaaaggtctgagactccaggcctatggggttcttccttcaggctcctaaattctcccaaatccatctcttctcttttgttccctcagccctaaaagtaattgctgcttcttgtggtttctattaatatctaagttacctcagcaatctcttttggctcaggtttccaacacttgtgaactaaatacatatattaaaatccctcgttttctttctgctttcctggttggaatttgactgatatcggagaagttctagagaacagcttaatccttaaccttactaacactatctaactcactgctatcaagtactagtttagctattaataaagtgatgctttgattctccatcttttgtgaaatgtaaaggaagagacagagagattagtacaacaggattcaggtattcctggatgccagtgttaatatcaacatagtagtactaaaatctccccatgaagccctagcaaatgttaagatccatatattttaattttagctactaaattacatgcagttaactcacttgacttaaagaaatgtgatataacaatggattaaaaattgggagacttgatttctagtcctgactctatcataaaatgcgtgcctttatacaagtcagtttacttgttagactaaatctcttactgagcttctggctattattctacatccattccactccatcttgcctaatgctgacatctagtggatggatacacttagacttcatattatagaatgaaaaatcttatttcacctatttctgttgggccatgtgcaatggatataataaattaggagaccaatactgttccttacatggaagtgaaacacaataaaatagtattagatcagattgtcatggtatctttgaatctgattcaaagattactggcactcttccatgattccagccattaaatgttaaaaaaacctctattacaggaggtaggaaaaggaagagtttaaccaccaatgcaaattactgtcagagccacatatttagaccatgaaagcacagaaacacatcctgctacaatggtttgcatcaagtacagacaaagagtatgagaagggctagtacaaaggctcaaggcaagtaatacagaagtttctggaatggaatatgatggaaatatgcaaaacaactcaaaatgacctattttataaggacttactatgaaagtttctcttgaaaatacgttatcattagacaaatatagtattctgaattcattttgcaaacattattttaaaatctatgaatgcaaaatgaattttatttcatgtcaacaactcaaaagaaaagcctggtcacacaagtccactgtcacatttaattaccaaaattgtcagaattttttttttttgtggagtagcattctgcttttaactatggctttctttatatatcatgctgtaaaataaatatatgccaatagtttcaatgattacttctggaaatattttattttagaaaagtttcatttcattatatatttcaaaattacactaggctgatgtaaaacgcaagagcaatgggcacaattgggtggaagtgtaaactactatgagaagtttgggaaattagtctgacattccttctgaagttcatgtgcaatattcacataatgaactataatactgtgcaaacaaattaactccagctacatacgataaagatgaataagagaactataatgctatcggcaaactgtacacaatataataccattaaatcaaacatcatattaaagatactggttatttatacagggggagacaatcataggattgggcaactttaaaaacctgagaattattctagttcctcaattagcggcggatttgtgggagttttatttttaggcttcacaatttacaaatgaagtatgcacactcttgtatgaatcagtaattttgaatgtttaaaaatgtaaagccattgatgctcagagaacacgtatgtctcactgaaagatgcccaacaaaaaagcttagaatggaattcaggtacctacctctttctaatacacatgctacaacgcatggatgatcagttttttaaaatgtatcattatataagcctcagatacttctatatatttagcttttacagtatcagtggtggtagtcgttttaaatcaaacaacatttacttagcacctgtctgccaatggctatgatgaatactgaatatctggtgctgaggaattcacagacaagtggaagagaccagacaagcaagtgtgggtatgctttcataaagaaaaaagcaaagggcattctgaacacacagaaaaaagaatacctaacccagtcttggtaaagtaaataaaagcttcccagaagggctgattcttaattctttcttgtttgctatttatttaaattaggaagtaattccaacataaagtataaaaaaaaatactattcacagtctgtcacccagattaaaactataacaatttagcaatagttgcttcagatgggctacttttttgtgtgtgcagttgacctcccaacctctttcaatcaactttcctcccctcctctctcactgaagataattagtatctttttaaaaaaattattagatagagatgggttctcgctatgttgtccaggctggacttgaactcctggcctcaaccgatccttccacctctgacttcaagtgctgagattataggcatgagccatcacactaggcctttttttttttttccagcatggtttccttgccaaacatattttaagattttttactccaaaggtatatattcatcataaacaatacagtattgttctgcttttcaatttgcatacgtgatatactgtgcattctttgaaaactggattttctcactcaatagtttttaaaaattattaatatgttcattgtagctattacatactattggattattcaaagaaaccagtttattcattcctctactgattgacaatgagattattttccacttttaaatattaacagttatgctttacacctccatacacacactacatatacttaagctcatgtacaagagtcctataggacagctgtctgaaaatgaaaaggcaactgtaactttaatacatggtgctaaattgctctcccaagtgcttccatcaattctgttccacaggtacaaagatttcctatttcctgtcctccaaaacctcaagtttaatttttagagtctgaaatgtctcactgatgtttaaatttgtattttcttatcagtaaaaatgtgcacctctttgtattatatgtttatgggccatctgtgaagtgtatatgcatttcctttgtcacctatggtccttatttttctgttgtttcgcagccccactcctacctttctgcactgctggggctgagaatgcaaatgacatttcccagacatctttgccagctgggttcctgttaggaggaactggagggtgagaagacaggaggaagagagaagttactgattagaacaggctagcagttgttgtaggagcagtgtgaatagtatccaataccctaattagggacaggtgcagcctgtaggttccagcctagtggtggcagcagcttgtctctggtaaaagcagcatcataatttcttattttatttttgctactctgttctctcccttgttccttttgctcttccagcttttctagtatctttgtaaccaatcttctatattaaattgtttgaaatatccagagtggtaagttttcctaacttaacttcaactgtcataccactcttttttcaaactgagtgttagaaatatatatatatatatatttttttaattaatttatttttttgagacagggtcttgctctttttcgcccaggctggagtgtagtggtgtgctcacggctcactgcgacctcaaccaccctggctcaatcgatcctcccacctctgcctcctgagtagctgggactacatgcccgtgtcatcatgctagtgtgtgtcggcggggttggggtgggggtgggggtgggggtgggggcaggggcagggggaatactgttgttgtttgtttttttttgtagagacaggatctcatcgtgttgcccagactggtctcaaattcatggccttaagcaatcctcccccaccctggcctcctaaagtgctgggattacaggcatgagccatcatacctggcagctttagaaattctggataccacccttttaatgcttatatacaaggcagatactttcttctaggatctaacatatcttaactttgtttatggtgttgtttgtcataacagtccagtttttcatttttcttcatggtctgtgcttactgtttaaataataattcttcaaaattgccttattcttgcccttttattcactcatgtgattgtcaaattctacaaaaaaattctgatgggattttgatttgattttgcattaaatatataattgccatctctataatttcaatcattttgtcatttaatctatgaatatgacagattacataaattcattttctgttgctaaaccattcttgcattcctgagatcaagtctgcttggttggttatttatttatgtatttatttatttatgaataaatgaatgagggtgaatgaataaatttgaaacacggtcttgctctgttgcccaggctggtcttgaactcctaggctcaaggaaacctcctacctcagcctcccaaggtgctacaactacaattacaggcgtgagccactgcacctggtttatttgatcatttaaaaatatatattcctagatttggttttgctaacatttcaccttggattattttgtaagactgacctgtaatttttttctctgttcctgtctggttttgctgtcaagcctatttttatacatagatttttctattatttagaaccatttataaacaatacaatgtgtcaattactcagtgagttttataggaaagttcttccaaacatctaagaagtctacatctgtttcatttttgaaactccagcctaacagacattctgtcacacagccagtactcaataaatatttgtcaaattaataaatgaacaattcaagtaaaaagcagcttatttatccaaaaagagaatacctaaactaagggcatcccataaaaagagtaggtttaggtcaaattaaacaaagtgcaacttaataaattagggactaagtttatggaataatcccttagtcttacctacgaagggataattcaaatacaagatctataaacatcaagaaaatcaaggacaaggttaacaggcaaaggtttactgctaaaacattaaagctggcctggacagcaatgatattttcccacaatactctttaccacctctgagctaatcttcaatggtgtttcccatgttcttatgcattatcgcaatgagagttcaaatccttaaaaatcctgatgaccaacagtcatcttcagaagtagcaattttagttttctgctttttgcacagagaataactaagggctacagagacattctcatccattacttataaacatgccacccacctccccagagtgagagtctctggtgcctcttccagtcaccaaacagcagcaaaaaagcaaggaacttaaggacctactgccaagtaaacaggccttgtggcagtgaaaggataaactgtccatcattctttcttctcctcggagatttcacaggaaaaggagaaagcgcaggaaacaggaggcctacaattgaaaggaaatctgccagaatttggcatatagaagtaaagtgtcattcctagtcacctcactatgactgaaatggataagagattcttaaaaattgttctgctttctctcataatttgagttaaaagataaggtattctctgaagttaagtatcccttaatttctggggttgactaggggctcttctcaacactatagtcactgtgaagagtgaaagacaacaggcagaatggctttatatcccattaccaataaataagagaatctcagaccaggaagggaccattcacggtcaaatggaagactcacccttgactatttaaccttagtatgaatctattctacaacatatccacaccaagtagccatctcaccactgcttaaatactctacatgacttaaattttagactttggtcaatttttagaaaaatttgtagaaacttaagacaatgactgaataagcacaattaagacatgaattctaccctcgaaaaccatacaatccttgtattaaactgaaattcacccatttgttaacatctcctccttggtttaaattctctttggcctcctagaaataaactaaacacaatccctgtgctacttaacaaaccattaaatatatgaagtatcttaaaacaacagtcaaatgaggtcaaaataaagttacccatcagattatgtatgttcacatttgcaaaggtacaaacaagacatctcctatctagtaatgccagccaagaatttagcttctgagtagagtttataagtgattttctaggtagggagaggcatggtgggcggctaatgcctataatcccagcagtttgggaggtggaggtgggaggattgcttgagcccaggagttcgagaccagcctgggcaacatagcgaaactccatctaaatttttattttttgagacagagtttcactcttgtcacccaggctggagtgcagtggagcaatcttggctcactgcaatctctgcctcctgggttcaagtgattctcctgcctcagcctcccaagtagctggaattacaggcatttgccaatacgcccggctgatttttgtatttttagtagagatggggtttcgccatgttggccaggctggtcttgagctcctgaccaggtgatccacccgcctcggcctctcaaggtgctggaattacaggcgtgagccactgtgcctggccccaatctaaaaattttttttaagtttttttgtttttttttttaaaggaatactcatcacaaagaccttgttaaacattataggctaaagaaccaagggcagtggaaacttttttccctgtgatcttaacttctgtttccaaagcaccctgcagagggctttgcatgacgttagtgctaatgttaagttaataaatgaacgtttattgtggcacatacaattcatccaaaaacaattaagaaaaatttcaagtgttcctaaaagaaattagtactaaaacttctaagttagaaaaaaaatttcactggaaaaaacttttttaagaaaagcagtaagtatgttatggatggttggatgcagaagctaaaagtaaaataaatttaaaaaagaaaaatgtatgcttattaggaaaagaagacggatgttaagaaatgttcttaaatagttttcaacagtttgtcaggtctttctgtttgagccttgtacactaacggaatttaatacaagtgaaattacaaaaggcacaaatgttttcctggttcttgaacttaatttaactgaactaaaattaaaatcattctcttaaatctatctcctccaggcttatcataaccaaacagaatacaaaaacatatttttcttctcttggtaatagaattttaaagatatgtacttgaataattttctacattaataaatcagtatctcttacagtgctaaaaagagtccagcagaggtcattcatttacattctgatgttgccaaggaggtggtaattataactgaatatatacagttttactttgcctttctttttttttttggagtctcactctgtcgcccaggctggggagtgcagtggcaggatctcggctcactgcaacctctgcctcccaagtcaagtgattctcgtgcctcaccctcccaagtagctgggattacaggcatgtgccaccaggcccggctaatttttgtatttttagtagagacggggttttgccatgttgaccaggctgatctcgaactcctgacacctcaggtgatctacctgcctcagcctccaaagtactgggatttacaggcatgaaccactgcacctggcctttcattatatcattttttaaaatacaattttacttcagaaagaagtaaaattttacagcagaaagagatccccctcagtaaatttaaaaagcaggtcccataattattttcaaatgacaaatgacaaggccaggtatctttgtaaataattttgcaaaagctggtttgttttattttaaaggctgatttatataaaataggaagaaacctatgttttcttaatactgtggaataagctaattgtaaatgaaatgttgagatcattattaggaccaaatgcagtatgtgcatatcatataaatttttttaactaagtatgccattaattattacaccttctagtttcacaaagcatataaaaaggaaatgtttatataaagcaaagttcaaatcactaaaccactttgaatttttactgtcaacctacataacagagagaggatcacaaagaaaagatgtttatttcagaacagagcattgcaataggaatatgcataacatagtaaactatgccatacatattcagggaggtaaaggaagacaaaggtttttaaaggagaaacaagggttatataatagttttgaaataaatatccttagctacaaagatcaataacaagggtgacaccagttggaggctgaacaggcagttgctgggcagatgtccttgcagaagtactattttgtgtaaggtggtgatggcctttgtgtaaggatatggtctttgtagtctctttcattatcaggcatacaagtgtgagaacactctcttcacagccttccctggctctgtacacagcttccctgggtttccttaacattagtaactccattttgattctgaagactttcactaccacatgtctaaaggtgctaaaaaaacggagaaaggggatgacaaaggatagaaaatctgagcccagactaaagggtttgtgaaatgacttgaacgagctcaactccctaattttatgaaagaagggaaataaagactagagcaacctggtgacttggacaaagcagcaaatgagtaaaaaaaaaatgtggggcttaatccactgactctggcagtgcagcttttgagaacctctttaaaacatggcatcagggccagatgacatcaaaagaattaagtaccaccacaacaaaggaaacaaaaacgaaagtcacgttcccaactatgtcccctttgaaatgattgttaatgctgtttttgctgttaatcaaactttaacagacctgacattcaatttgtagtcagtgtcagctgctgggcaaacactgggattcggggacatcattctaggctctttctagatcaggctgaaacttaccaccgtacagcttatactactgatggaactgcaaaacagctggtgactttctgcaagtctctacctttttcttgttttcaaaacacaattatcagagcactactattcgtatctttcctatggcaatgatggcgtttctcttcttaaaattttggtgtctcatactgatatttgggttttgggagggtgttttttttgagacaatgtcctgctctactgcctaggctggagtgcagtgacacgatctaagctcatggcaacctccgcctcccaggctcaagcggttctcgtgcttcagcctcctgggtagctgggattacaggtgcgcacaaccatgcccggcttgtatttttagtagagatgggatttcgccatgtgggccaggctggtcttgaactcctggcctcaagtgatccacccacctcggccacccaaagtgctggaattacaggcgtgtgccaccacgcgcccagccctgatacttgttttttacatatttacttcatgttctttgaaggcaggcactcgccaaggcttaacacttattttctactctctttctccacaaaatttgggactacagcctgggactacaggcacacgccaccacacctggctaattttttgtatttctagtagagatggggtttctgttattatggaccagcaaatagaagcttcttcaaagctatttcacaaacttctagcctacatcattaggataccttttttttttgagagacagagtatctagctctgttgcccaggctggagtgcagtggtgagatctttgctcactgcaaccttccaggttcaagtgattctcatgcctcagcctcccgagtagctgggataacaggcaggtgctaccatgcctggctgatttttgtattttgagtaaagacggggtttcaccatgttggccaggctggtctcaaactcctgacctcaatccacctgccttggcctcccgaagtgcgaggattacaggcatgagccaccgtgcccggcctgtaactacttaagattagtcatatagaatgtgaaaaactacgcttactgaagtatgatggagaaaggtctagctgaattttcactaactgaggttcttaatatggggagtccatagagaattcagggatctgtgaatatggatgggaaccttttcactaacctctatacaaaaattaacaattccttcaatcaagaatattagtaacaaactacagtagtattagaaaacctatgaatttgtcattaatagaaaccatgggtatttttgtattacaatttttgcacacaacatctatttaaaattatgatatatagtatatttactcctaatgcttattctctaacatgagaaacacacatattaatgtaagaagcacacatattaatgtaagaagcacacatattacttatcacaaatttgtatttagtatttgttaatggcttttcaatgtaacgtttccttcttaatcctatgtagtttacttcatacaatcatgaatcattattagaatcattattctgaggcaggattcataggcttcataagattgccaaagaggtccttggcacaaaaaatactcgttaagaacctctgaactgtaaaatacagagtaagcaaggtgataacaattctgaaggactgtcatagaagtaactgttgtaccagctctaataaaatgatgggctggatttttgtttttgtttttattgtttttgttttttgacacagagtctcactctgttgcccaggctggagtgcatggcgtgatcttggctcactgcaacctccacctcctgggttcaagcaattctcccgcctcagccacccaagtagctgggactacaggcacacgccaccacacctgcctaattttttgtatttctagtagagatggggtttcaccatgttggccaggctggtcttgaactcctgacctcaggtgatccacccacctcggcctcccaaagtgctgagatgacaggcatgagccactgcgcccacccttgtttttgtttttagagacagggtcttgttctatcacccaggttaaagtgcagtgatgcaatcttggctcactgcggcctggacatcccaggctcaggtaagccaccacgaccggcctgatgagctagttttgaaaaaatatactctgtttataactaagaagaacacggaaagggattttaagctagtcattttcacttaagaacacaaaatctgcctgtaaaaaaaattacattttgaatacttaataacttgttataattaaaacaactgcaggattacaaatgtttcagtactcaggaccctttaacagtaactaccttttatggtaacgattctttgtttctaaaaaatttttttttaaaaaaaggaccaaaaccagtaacagatagaattcttaagattatgtgtaaagtgtcttcccttctgttttcaatgaaaaaaaatatatatgtacatatatatactttaaactactaaaattatggcttagaactttcttgatcaactatactggtgacagctaaaatgacttaattcaaaggaaaacacatacctctcctaaagaaagaaagctgttaaaaaaagttctaattaatttacattttccccaccaggtcctattctaagccaaaaactaaacaatcaatatttcctaacaacatttttagcaactcaatattgtgtatagaacatttcccttaaattatatatagttaatataagtttttattgaaatcataacttttcatttatatttgaataatcatttcccccaaagacatatttaccttcagccagtgctggtgattctgtccttgtccttctatctgtttaaggaaagaaaaaaaggaagaaagtctaaaacattattatactttaaaacaagtttttattacagttaactttaaagtttacgaatgccatcatgcacgtgcacattttatacatacacacatatatttatttatttccttggattaactcaaccaccatttatggaggacctatttagagtaaggcatcatattaagccctggaaacaacaataggtaagacaacccagttgtcaccgtcaacatactcagagagtaaaaagtgtacgaagacaagtacacaattctcatcatagcttatgaagcaaagggtaagaaaaggaaagttagttattcctctttagtcttacagcaggggcctaaaactatgaaaagaggcatatttatatttcttatcacagtttaagttcattcagtttcaatgtattaataatcagttttactcaaggtattaaaatccttattccgtgaccataacctattatttgccagggacacatttggcaaaattcaagtgaaccacaaagccctctctaggattggttttattatttcactcattcattcattcatttctgcagaaagagggtctcgctattttgctcaggctggtctccaattcctggtgctcaagtgagcttcctgctttggcctcccatagtgctgggattacaggcatcagccaccatgccgggcttggttttactatttcaaacacacaattttaggtaaaatggaatcttcagaatgagtataactttgcaaataaggttataagaagcaaataaagacattaaccccttggagaagaaggtatggatcactctatcaggaaaaagcctcatgttttcactctagctgaggtacctcctcctgattgtactatctgtggttcactttctgctctggggctttgcaataggagacgtctacaggaattcttcagctatccagagatataaacaaacctgaaaatttgaaggtgttaacaccatgggcaacccttgaccaacgagagatgggatctagcaaataaataccaccttcttcccagcaaaaggcatatctttattgctttctcacagggcttcctcaggatcaagccccagttgctcacagaagtgagcagctcaataacgcacccttggattggcgttccctctttcctagttcacttgttccagtccttcaacttctgtttcttgctaacaggtgtgcaaatgaattacctgtaagaaagcacccatctcagtttctgcttttggagtgaaactaggtcaagacacttgatttccacaataccataatcccttttcatcctacctcactggatgctccttcttaatttcgactacgctttcttgcacaccccatattccacccaaactctcactacctaaaatccttgtgcctactatctcctactaactcaaggcagaagattctgttgcctgagcattatcagatctactactacttcatattgaagagactagaacagaggttgcaaaaatgcatatggagttggctggctgaggccaccttaggtaaatgttaaccaggcaaataaacgtgtgtgtttatctaaatggtgccactgctatcaacatgccatgctaaaaatacaggtgatacagagctcaatatccatgtaaaacagattttagacattagcaactaatgaaataagtcagacactcaacaggccaaatgaaacagtctaagggctatacgtgcatgaaccaccagtttgcaacttctgctccagaacctcacgttgtctacaatttattttttaattaatttatttatttgagacagagtctcactctgtcacccaggctggattgattgattgattgattgattgattgattttgagatggagtctcactctgtcacccaggctggagtgcagtggcgctacctcagctcactgcaagctctgcctcccaggttcacgcgattttcctgtctcagcctcccaagcggctaggactacaggcgcctgccaccattccccgctaattttttgtattcttagtagagacggggtttcaccatgttagccaggatggtctccatctcccgatgtcgtgatctgcccaccttggcttcccaaagtgctgggattacaatctttcacttttctctatgagttagttcacaaatgggagtcacgttcaaagcctaactgttctagcttttctcaaaagcttgccttggatcaatattactagaagtgaaatgaataaacactttttttgctttttctgccgaagataaaacttccttccctaaggcccactgcaggctcccagaaataaacaaaacaagtggcttgactgaccacttttataaaccacagcagaaaaaccagtgccactttgcataaaatcatgggggaaaattcaattatttattcttaataaatcaagacacaataaaacacttgtaactgtattcacccttagaaatcaaatatcaggtcataaatagtaaatattaattaatatttaaattggatcatccaggcacctaaaatctacaaacctagagattcctcaagttaagtgttaaaatttacttgcctccatacaaacaaatggaagaacattccatgctcatggataggggaaaaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatgctactggtaccaaaacagagatatagaccaatggaacagaacagagtcctcagaaataatagcacacatctacaactatctgatctttcacaaacctgacaaaaacaagaaatggggaaaggattccctattcaacaaatggtgctgggaaaactggctagccatatgtagaaagctgaaactggatcccttccttacaccttatacaaaaattaattcaagatggattaaagacttacatgttagccctaaaaccataaaaaccctagaagaaaacctacgcaataccattcaggacataggcatgggcaaggacttcatgtctaaaacaccaaaagcaatggcaacaaaagacaaaattgacaaatgagatctaattaaactaaagagcttctgcacagcaaaagaaactaccatcagagtgaacaggcaacctacaaaatgggagaaaatttttgcaatctactcatctgacaaagggctaatatccagaatctacaaagaattcaaacacatttacaagaaaaaaacaaacaaccccatcaacaagtgggcgaaggatacgaacagacactttcaaaagaagacatttatgcagccaagagacaagaaaaaatgctcatcatcactggccatcagagaaatgcaaatcaaaaccacaatgagataccatctcacaccagttagaatggcaatcattaaaaagtcaggaaacgacaggtgctggagaggatgtggagaaacaggaacacttttacactgttggtgggactgtaaactagttcaaccattgtggaagacagtgtggcgattcctcagggatctagaactagaaataccatttgacccagccatcccattactgggtatatacccaaaggattacaaatcatgctgctataaagacacatgcacacgtatgtttattgtggcactattcacaatagcaaagacttggaaccaacccaaatgtccaacgatagacttgattaagaaaatgtggcacatatacaccatggaatactatgcagccataaaaaatgatgagtttaggtcctttgtagggacatggatgaagctggaaatcatcattctcagcaacctatcgcagaacaaaaaaccaaacactgcatgttctcactcataggtgggaactgaacaatgacaacacttggacacaggaaggggaacatcatacaccggtgcctgttatggggtggggggaggtggggatagcattaggagatatacttaatgtaaatgacgagttaatgggtgcagcacaccaacatggcacatgtatatgtatgtaacaaacctgcacattgtgcacatgtaccctagaacttaaagtataatttaaaaaactatatatatatgaaaaaaaaaatttgctggcctccagcaagacatgagttattacttcagaccattctgtcaaccatgtttacagctctgtagtatttcaaatgatggtacctatgatggcctggtgcagtggctcacgcctgtaagcccagccctttgagaggccaaggtgggtggatcacctaaggtcaggagtttgagaccaccctggccaacatggcgaaaccccatctctactaaaaatacaaaaatcaaccaggcatggtggtgcatgcctgtaatctcagctactcgggaagctgaggcacaagaattgcctgaacctgggaggcagagattgcactgagctgaaatcacaccattacactccagcctaggtgacagagtaagactctgttcaaaaaataaataagtaagtaaatggtgttgaaataactccatggaaaactaagacagacccttctcaaactatacattacacatggatttgagtttaatttctcaaaactaaatctcagaaaatagaacaaagaatcttacttatctttggaggaataatatgctaaaatataaagcactataaaaaatttaaaatggaaagatgaatcaatcatgtaaaaattaaagataagggataccaaaatgtcttaaaatagttcatgggagtgtatataaatcacatgaagacaacagaaaaaaataaacgataatttgtaacagggaggcaaaacaataaattatgaaaaaaatgtatactccctaataataaaaagcaaatatggtaaaatggtttagagaactggttctgaaatcaggcttgggttgcatttccaattatttaaattattaagttatttgagcatctttatttgtaaaatgcagattttcacttatttaaattaggttatctatgcatccttttcctttgtaaaagagcaaaaataaactcaaagtgtgtagattaatggaaatgctagttttgctgaacatggtcattaccttttgtatttaatatttaatattaaaattacaataatatgtatctctctactgacactaaatctcaagtacagtactcttaagaaaaccatgtctaacagcaccagaactcaaacacctgaggattcctctatgtcatcctacaccatgcttactaccacaaaatagtttgatcagaagaaagcacaatggttacattaagagcctccctccttgatatacctagaactacattttctatataaaaacaaataccaaggcatatatgatacatataaatcttaatactgcgcaaatattaatactaaatattaatacaatatcaatacattctttttttataaagattttaaaaaaatgtttttaaataaaatagagatggagtcttgctatgttgaccaggctggtcttgaactcctagcctaaagcaatccccccatctcagcctagcaaagtgctgggatcacaggcatgagccaccatgcctgaccaagaaattcttaatctctattgtaaacccatgctccagaagatttgaaataccaacatttctaattatctctaaagtttttttttaattacctccaggaaaaagtaaattgcagtaacagttgcctaggtaatgccaggctttcagaacatgacttgatttttgtagagtctaaaaagtttttacaatcttaattttcccctttattataagggtaaaacatgctcactacacaaaatacataaagaaagtggaaagaaacaagtaccactacctataatcccacaaccaaagctttaacaatttattctcttctaatttcttttatgtatatttttatacaatttaacaccctttctttgtatttgtactgctttttatcattcacatcatgagcaatattttcacatcattaaaaactctgccaaaataccacttttagtctttacataccaactcatcatatggttgtaccacattttttcaagcattttctcactgctggacattcaggtttttctaaccttttgctcttttaaacgatgctatatgcccaagacttccataagcacataaagactttgtgagattagaagaagttatcccagtctaatataaaaacgtttatgaactattattttattacacaacctcaacaactacacaatatagctctgcctgggttggggtttaagaaccccagcaagcaaacaccctggctgtgcatacacatgcccctgcacacaagggtcacgctcttgcctactgacaaacataatccctgaacattaaggcacataaacatacctaagccagtgccaggcacccttgccccaaatttctcaaatgagactaccagatcagtttctgtcagactggagtggtgggcaagttagcgaaagacatcacctcaggggatgcctggagtctggagctcagtctggacaagaccatgctgtaaccacctgcatggacagagtgtcctcacaggagctctccagagtcttcgcatgccataggtgctagtatgggtttatgtaccaggcaacttactgtaacctggaactcctggctccaagatgtggccagaaggcccagaatcccttcactcacccacggtcttctcaaagtgacatgtctatctcatgtctgatacacccacaggtgtggcaccccttgtgcagagggccatgtgaacaccttgaataattatcttagctatgaacatatatctttgttgaaataacttaaaaatgtttaggatacatcaaggtctttatacctagtgccaaattgctgtccaaagatacattttaattaacactaccatcagaatgatgcactggccaacttcacagcatccttgacaagtggtgccttctttcactttttttttttttttttttttttttttaaagagacaagggccaggtgcaatggttcctgcctataattccaacgcttcaggaagctgaggtgggaggatcacttaagaccaggagtttgagaacagacaagacaacatagcaagaccatatacacacaaaaattaaaatgaacagccaggtctagtaacatacaactgtcgtctcagctacatgtgtggctgagacaagaggatggcttaagcgcaagagttcaaggccacagtgggctatgagtgccactgcactccaacatgggcaacagagcaagaccctaattctaaaaacaaacaagagaaacacggtctcgctctgtcgcccaggctggaatgcagttgtacaatcatagctcactgtaaccttgaactcctggcctcaaggtgttctccctccttggcctccaaaagcgctggaattataggcatgagccaccttgcccggcctctctcccattgttttgttaactactgaggccagctattttttcctccacaattgtgtaacttagtccttcccattttctatcaaggccttatgtatttttaaggaaataactatcaaatctgaacttccttgatcagatactcaatataaatgtataaagtgaggtacagtcttttaaaattgtccctttctactcagctgcctttttctaagtacttcctatgttttagacactgtactgcatgatatatttcacataagcctgtgaacctaataggttaaaattaaacccttttcattgatgagcaatcagaggctttaaaaggttaagtagtttgtccaaggtcatgactagagggtaaggaattgggaaaaggagcggaagggacagaaatgaggaagggaacagagggagaaaattacttttcaggaaacaatcttgttcaatatttattataatattcctttctgtagatgtgatttcttgtaaaacaaatactacttttccactaacttcttttattgtaaaattaaaaatgattctttaaaaaaataacccacggccggacgcggtggctcacacctgtaatcccagcactttgcgaggccaaggtgggcgaatcacgaggtcaggggttcaagaccagcctgaccaacatggtgaaaccctgtccctcctaaaaatacaaaaattagcccgactgtggtggtgtgcaaaaaaaaaacaaaaataaaaacaaacaaaacctacaacagcaataatgctgttttcaattatgaaaaacctgaggcaagggctaaattaaaaggctcaccaggctttgaggacattatacagaaccttcttacttctggatctcctggttactgtcaatatcttgccctgattactgaccatctacaatgggacttttctgatacttcaactcagctaagttttggaacatacagccatggagagactgtaaaatgcatttttgatggcaggtgctgcaatcgtgctaacctaaagattccacaggtttaagatacgttctgtgaaaacaagtaagtaccttattttgcagctctataagctcaaactctgtaaaattaaatgctagttaaaagaaagaatttttagtgttcatttaatctaccccacatgttcaaacccccttataacatttacacacataattttaaaggaatggtaaatacaaacagaggtaataacataaggcaaataaagctttacagtttatatatatacacgctccaaatttaccccaggttcgatttcataaaagatcaattggttgaatttatacatcctgctaaatatatatatatatgctccaaaattatctgaagttgcaaactgcactagcactgaaatgaccattccttccagcttctcacctgcttcaccactcccccagtaccactctctccacctctagtccaatgctgcagttatctgaaattacaaagtttttttttttttttaattatgaccaagtttggcttacctgagaagtgcaaggttggttcagaatacctactgttttcaccaccctaacagattaaaagaaaaaagccatataattacctcaaaagatgcacagatgcactctggggttgggggaaggggaggactgggaacagagaaggtgcatttcaatgaaaacaaagacttgggttttttaaatttgcctttatttttatttttttattttagagacagggtcttattaggatgcccaggctggggctttcttttcttgcaagtcatttttttttcaaacaattctatatgataatcaacaggatgaactaatgaaggcatattaaagagtggttcaggtaaaatgattcagtgaattcctaatctgtgtgtcatgtttacggtgacagaaaacaagtgtgttctctactgctgttaaagttatctctactgctgataaatttaaatacaaagcgcaaaagtgaatcctacaatgcaataccatgactttcaggaatctgcttcactttttttttttttttttttgagacggagactgctctgtcacccaggctggagtgcagtggcatgatctaggctcactgcaagctccgcctcctgggatcacatcattctccggcctcagcctcccacgtagctgggactacaggcgccggccaccacgcccggctaattttttgtatttttagtagagacagggtttcaccgtgttagccaggatggtcttgaacttctgacctcatgatccacctgcctcagcctcccaaagtgctgggattacaggcgtgagccacccctggaatctgctccactttcaaaatcatgcctacataagcagaagctcttgagataaaccttgtctttccccacagtgttgtaattacagtaaaagcttttccataataatcagaactagaagttgttcaattaattgcaattattgatagaaacatttaaaatacatacacgtgcattcattagctaatccttttttaagaaaaccaaagcacattcttcaatgacaagccattgctagagtattttccagccactatgatccaatgtttttgtagaaattaccagaggagaaaaatatttaatttttaaaaacttacaaagtggaaattccaattcttcacagactacgtgtgaacagttcatggaccagtgctggtttgcaaagtgcgctttgagtagcactagtataaataaagcacgggctctggagccaaactgtgagcctcacccttggacaagtttctctctctctagtggggataatattaatacctaccacctaattgggttattatgaagattaaataagaatatgtctagcatttaaaactgtccctgccagataaggactctataaatgaaagttgatgttattatcattattactattgtatagaccataaccataaatacactttttctaaaatgtctagtttttgtcttttttaaatgtaatgagaaatgaaggtactgaaaatacagaattctttatagttttatccttttctccaattttttatatcctgatccatgaccaatcatatcacttcttttaaagtgagtcactagtcactgcatacctgttattcactaaatgtacaggctgcagagcagtagctgtcctgtgttacttccctgtccccagtgacaaatccatgagatactttttttttaaatgggcaactgaaggagaggatttgccaacaaagacgaaagtgaagcaaagaaacaaaagcgataatgctggaaataaaattctaatggaatataaatggagttacaaaagaaagagttgactgtgagaatggtgacaccgctgccaacagggagactaaatatgcagccagaggaaccttctgaaggtaaactgatcaacataagagagtggttatggtgaaaaggatgacaatgtctcagaggaagtcatgccagcaaaaatccttcatattaaaggaacttttacatatacttcttgatattcacaatgtaatggataaaatgtttgaagctgattcaaatttagaagtattaacaacttgtccaaggcctagaaatgatgctcactccacactgtacaacagggaagaagaaaccaggcacagttctaattactcttgaaaagatttttacaaataaataaaacactttagttttcaaggtttaaattacactgtactaagtaaatactagttttactgttttatccatttccctatacattttgcaacaatgagagttatgttttgacgaaaatttctaaaaatcatgaacaacataatttctaagattgctttgcaaaatttaagtctgcacaagtatttttacattccacagcacaaaatgagaactgcctgtatacacaactttcacaacctaagaaggaaagcaactgaatctaaaaacaggcaaaagatttcaacagataattcaccaaagttaaatggactgcaaataagcacttgaaaagatgctcaacaccatcgggcactagagaaatacaaactgaaaacataccagatggctaaaaaaatactgtaaatgaccataccaagggctggtgagaatacagtgcaaatgaattcctatacacttgtgcaaagccactttaaaaagttaaatatacaccttcaatatgacacagtcattccatctacgtattcatccaagaaaaatgaaagcattatgttcatacaaagaatcatacactaatgttcatagcactttacttgtagtagtctcaaactgcaagcaacccaaatgttcatcaacaaatgaatggacagactgtggtatttccatatgctagaatactattcagcaataaaagaaacaagctactcacacatccaacaataaatataaatctcaaaatcactatgctgagttgaagaagccagatataaaagaatatatattgtatgagtcctcatatataagattctaggagttaagtctgggcaacacagtgagaccctgtttctaaaaaaattaattaataaaaaagtaagattctaggaaacgcaaactaatataaggacagaaagggcacaggtggttgactggcgtctaggggcaggtagggtggatagatttgaagcaggcaggaaaaaactttgaaggtgattatgttcattatcttgattgtggtgatggtttcataggtgattaactatgttgaagctccacaaactgtatgcttaataaaacttttaaaaatggtccatggaccatctgcatctgccaaaaatgtggattctcaggcttgccacaacccactaaattttgtgggtcaagcctgagaaattgcattttccaagatccacattactctaaggtatgtatttactctgtaatctagaggatctaatgcctagagtctccagaagaactatctcactcaagctttagaacttaagacatcttattacattcgtatttatattttaactttgaaatctgatatataggtgatctctgaaatagttcaataaaagaaaaaagcccatagagacaaaagttttaaagctaaaaataagctttatgatttcaatttaaaatcatatcttgtcccaattccatttcacaaatgggaaagttgagacccagaaaggttaaatttgggcagagtcagtaataaaatgcaaatcttctattctactttcttctgaaatgaaattctatccaactttcttctacaaaggcttctattcctctgctttcaatttctcctaaattcatatttattctttgtcatttccgtagctcagatttttatgctctcactcctaactactgcaataatctcctaaatggttaacctacttctgtagttctctccccactttatttctatcacacaaatacctgagtacctaatattagtcaagcactataagagacactaattttatctcatcactgctctattaaaaaaaaaaaacttctaatagctcccaatactcttcaggatacattctcaaactggcacacttaggaatgaatatccattctgatttcaggctactcctaataaacatgctactagagcagagccccctaacagcctatgcccattccagtactgaaatctgtttcctcctaaaaaggcattcctttcttccttctaaaaagattcttatccttaaagggccaatttaaagctattcctgctttcaacaggcttttcccgaggactccagcccacatcaatccctataattctaaagcattttcatccaatagtacactgctactcattggctgcagatgttagttgtataactgagggaagataaaatttgtttctcaagtcttttgtaccctatttaatatgcagtgcttaagtattttacaacgaagggaaacagcatagcatatataggtagaaaagttttagtctagaggctttgaaaccagtcaaataccagtttgaatcctagttctgacaattaccataactcaggatcacacagctagtaagcattagtttcctcatttgtcaaatggagttaacagaccttacagcactgttgcaagcattaaataagattcaatgagaatgcatgtttactgcttaggaaaaatcacaaacattcacttagttgtagctattattagcaacacagatcaaatatccaccatgtggcagatattgtactaggttctagaaacaccaaactgtttaagatttaagcgctgatcttaaagaagtttatgtattaatacataccaataccattcatccatccaagttagaaaacaccagtcatcattcttacctgtactgtaagacctgaaaaacctgaccattctatttcctgaagacctctactcacacaaccactgaactagcagttcaagccaggactcctactatagcctatttgggtctcactactccacctctaatcttttctaactaattctccataatgttattagaataatccttctaatgcagaaacctgatcacatatctacacatcatccttcccattagtctatatctgtaattgtaatggcataggacacaaagatctcaggctgactcaattcttaaaaaaaaatttccaagatttctcttaaatatcttggccaggtgcagtggctcaaggcctgtaatcccagcactttgggaggccaaggcgggcggatcatgaggtcaggagttcgagatcagcctgaccaacatggtgaaaccccatctctactaaaaatacaaaaattcgccgggcatggtggcgcgtgcctgtaaccccagctactcaggaggctgagacaggagaattgcttgaacctgggaagcagaggttgcagtgagccgagatcgcaccactgcactccagcctgggtgacagagcgagacaccatctcaaaaaagaaaaaaagtcatttttatgtattgttaaagcagctttttaagaaatttaattatttctttaaatacttcagttgtagttttattagaaaatccaccctactactgcagtgatttaataacaaaaaaattggaaaaagaaaatccaccctaactcgtattacttcattttcacgtgtttacgagtgaccactggccagtacgtactatcaataatggctgcccaccacaattatccatggaccaccaccaccctgtttttaactatgcatgccacagagctaccacagcagattcttattcaccaagcctacggtacaccatggtatttgtttttttaagaagccacacaatgtttctaatatatagccaggattgcccaatcccagattgagaaactttacatagaaaagtgaccagatatgataatattgctttgtctatctaaagcaggggtctgcaaaccacccacagaccatgcctaatcccatggctttttgttctacccgcacactagaatgctttttacgttttctaagggttgaaaaaagaaaacaacaatctttatcctgaaagtagttaatgacttcctgtggaaataatacttgcatatataaaaagtaacgaattcataataattctgtcaacaccaaagtattgttacagactacaattacaacagaaatttagagaacaggacagtgtgagataaaggtatattccatgtgtgagttaaaaatcttctctgtaggcctcacagcacatcatatcactcatcaaaacgctggaccctttcccatgactcaaagtggctaccacaggctgttcattgttatcatactctgctctgcactaagcacaatgcctgaaacatcacagtctccaaagtatagatgctgaatgagtgaataagcaaacatcataaataatataagtacattagaataaatgcaacccgtctaaagttaaggttccaaaaggctgtcattctgctaaaatgatttgtttggggaaaagagagataaggagaggtcaatgtatcgttagcagaaaactggtaaaatttagaaaaatatgtaatttctcctattaaaaattaaataaagagacttcaaatgaaatactctaaggtgtgtccaccaccgttttacagatagtttttaaattattttattttacttatttttttaagagatgggtttttgccacgttggccaggcttgtctcgaactcctggcctccagtgattggcctcggccttccaaagtgctgggattgtgggtgtgagccaccgtgcccacccagcctacagatagatatagtttttctggactgataaaactcagttgcaccaataggcatagataaccactttggagtgatattatatatctgatatgtggtaacatatattaccgcatgtcttggtagcaatagaacaatagattttaagactatgaaaaatacttttgtcacatagtgttaaaaacgtcctcaaaactcaacaaagatcagttacagactcccaataggccagacattctatgtatggcaaagtacaaaatgctgtgtaaaaacaagatctgccctcataaagctcatagtctatgagatgacatgtaaacaaattactacaatacagtacaattaaataaaatgctatgctggagttctgtggttaaactgctatgggaaaacagatgagggagtaatttcattatgtctagaggagaatgtcagagaaagctagagaagtgagatgtctgggtgccttacatacttaaaaaaacaccagtactactaacaacttccaaagacatttttatatgcttcaaattaagtcaaataacttaattttaagatttatgttagcatatacactaaactggaaaaggaaaatcttctcctatacaaagcattttaattactacctatgattgttaacaatggggtaacataataaaataatactaaaatccttaagaaaaaggctttattaaactgagactgagacaactccaagaattcagaagaacaccgggtaagatttttcagtcctaataaatacaaaactgcactgatttattcaataatttctatcccgtttgctatccatgtttgaaccttaatctgtttgcccttctgttatttctatttattggatagcttatataattccaaatttggactatcaagtctgaacttacaaaccaaatcaggggaaaacactttcaaaaaaaaaaaaaaaagtactattctaaaaattactctttcatggtcagagtatatatttatgtagtaaacctttatctttaaaacatgtaagtccagcctgttaaatgtcctatgaagtggttctttcttgtctatcttctcctcttttaaaaactaccttacatgtcttatgagcttttctcccaagtgctcattagtagccacatggaatctaatgggttcaacagacaagacatcaatacacacaactataaatatatcatatcagataggttcatttctcaaaagagctcataattcttcagtagaagaactttatttttcctaacatttagaagtttcatagagataattaagtagaaatcattcagtattttcagattttggctatttctttatttcctagacttaaacatcttagtttaaatgatttttaacagatagtcacccacaaacagaatgagtgccataactgtacttcaactgctatgtaacagacttccatatcatcagtaatttttaactaggtatttcagactggaaaagataaataaaatttgattttaaaataaattctgaaaccattaactcataacatcctggatgttttaccttctgctaccctactcattcactaatttaataccttacaaaaacctgtacagtttagaaattcccctatcccctttcatttgatttccaccaaatgtaggagcacttacgtattctagatttcactgtttagtttactatttgcagtatctaggaattcattttatctacagagatagatttcttgaacaagagacaaaattttagtcatttgggaagtagaccttgcttccttgaattaacagaaaaaatattaaagtgcaagaataggaaaaaaattgtaagtactaaaaccacaaaaatggagaaaaatgttgatctatgctaaatgatgtacaagaaaatactgatcaccgaagtgaacagatcatcaatatttattttagccatttctttcagccttcttcctaatgtaccttttactcagacataagtcttatctattaaaaaataaaagttaaattgtatgtagccatcatttgtcacctttgcagtccatattggagaatgactgttaatgcttcttttcagaatttgagattcataacaatttacttatctttcctctacactattaaaaactgaaactaaaacaggaaggttttcttcttccctaacttcttgataataactaatagctattattcagatatacattaacagccattatttgagtgtatgtcctctcctatgttaggctactcagtgaaaagttttgggcaaccagatattcacatggtttcaaagtatcaccaaaccgagaccttttacaaggtctcactctctcgcctagactggagtgcagcggcacgatcacagttcacagcagccttaatctcccaggatcacaccaccacactcaactaatttttgtattttttttggagagacaaggtttcagcatgttgcccaggctggttgacaccatcttaattgaaggataaaatttagtatcaccaaaaatgtgacagacattatatgcctgatgatgtaatgcaatgggatgtattcaacattaccctatgtaataaacttgtcaggtatatataaactgattctatttatcaagaaacaaagcagacaaatcttgattatgaaatattttctatcagacagcttgcctggatgaaaaggagcaggtgtgaagattaaaaaaagaagaggagttcagttttggacatgttaaatttgagaggcttatgagccaccaatctgaagatgttgagaaggcaatgatggatacagaagtatggagttcagggaagaggtcagatcacaaatactttatctacaccccaggactttgtatccaaagaccaaggacacttgaaatggttcacagtggcaacagtaagagaccagtggccacactgcactaaccacactgttatggtaacataatctgggcagtattttcttgctgctcatctgcctctggttattgctcattttgtgaagctgggttcccactctctccatcaattctgtaacctacctgtcatcatcccaacaaattccttttatgtccaaattacctagtcagtttctgctatttgcaaccaaggacccgttaatgaattatgaagaatattccagtctcgaatagaaaactgtaatttccttcccaatttaaagccattcctacaaacaagcagaatttatggtacaaatataactctaaagtataaatacacataataaagatattcaaaaattaaagacggtacagatcagttttttgagatatttaagaggtcccaggataattaaaaagaaaactttgtttcaaaacaaaatttgaacattattataaaagtagaacacccagaaaaaaatggcaaaacaccaagatcatttaaaaaatatctaataaaggccgggcgcggtggctcacgcctgtaatcccagcactttgggaggccgaggcgggcggatcacgaggtcaggagatcgagaccagcctggctaacatggtgaactcctgtctcaactaaaaatacaaaaaattagctgggtatggtggcaggtgcctgtagtcccagctactcgggaggctgaggcaggagaatggcatgaacctgggaggcggagtttgcagtgagccgagatcgcaccactgcactccagcctgggcgacagagtgagactccgtctccaaaaaaaaaacaaaaaaagatgctttactttgttttatacattccaaactactcctactaagaatagtaatgaaaaaattctccggccgggcgcggtggctcactcctgtaatcccagcactttggaaggcaggggtgggcggatcacctgaggtcgggagctctagaccagcctgaccatcaggggaaaccccgtctctactaaaaaaaaaaaaaaaaagaatacaaaattagccaggcatggtggcacatgcctgtagtcccagctacttgggaggctgaggcagaagaatcgcttgaacctgggaggcagaggttgtggtgagccgatatcgcgccattgcactctagcctgggcaacaagagcaaaactcttaaaaagaaaaaaatctccacctaagtctacatttatgtatgtatgtatgtttgagatagagtttcgctcttgtcacccaggctggagtgcaatggtacaatctcggctcactgcaacctctgcctcccaggttcaagcgattctcgttcctcagcctcccaagtagctgggattacaggcgctcgccaccacacccagctaatttttgtatttttagtagagacggagtttcactatgttggcctggctggtctcaaactcctggcctcaggtgatccacccacctaagcgtcccaaagtgctgggattacaggtgtgagtcactgcacccggccaagtcaacctttagtctcttatttcatacacttccctcacacgtcagtaaaactacttttcattctttctaaaaacttttcacatttcaaatcaaaagtataattgttggctatactaaagattaaacatttcttacatccttgatagtacaccatttatgtactaaactccctacctccgtttagtatttttaaggaatacattttgaagaagtaaaacatgaaaaagagtaaaaacacttaatagggaatatttgctttaaggaggaaaaaagtacgaacatatgtgaatatctagtatgtaccatgcattctgctatagatgataattttttttttaaaacactgcaaaaccggtgatgttacctttttacaaaaagtaaatgaggaaaatgaatttcaaacactggtttaggccagctgcagtagctcatgcctgtatccccaacactttgcaaggctgaggcaggagaactgcctgagcctagaaatttgagaccagcctgggcaatcagtgagattctatctccaccccaaaaaaaaaaaaaaaaaattagccaggtgtggttgtacatgtctgctgtcccagctactcatgaggctgagatgggaggactgcttgagaccaggtcaagactgcagtgagctatgatcatgccaccacactgcagcccaagcgacagagtgagacctgcctccaaaaaaaaaaaaaaaaccggggggggggggggtggcggggggggtgttacttacctcacatcagtgctaataagaggtcagtgtcaataaggggtagatctgtttccagaacagatctgcctatcccaaagttgatgccactttattcacaacaaaatgcctccatgagcacattcttcgaaaaattcattctcattaatttttttattagaaaaacaattgtaaccattatactgaacaagccgaacccgtgggatgtaactataaaaaacaattttttgtccacgactagcctttaaagttactctgtagccatagttaatgtccctgaactttcatttaggctaatgatcatgactttggtcactcccaagttataaaaacaatctgacttttaaaactgaaagatccagctgggcatagtggctcccacctgtaatcccaacaatctgggaggctgagacagaggatcacttaatcccaggagctggagaccagcctgggcaacatagggagaacccgtctctacaaaaaaatttaaaaaaataaaaaaacttagccagatgtggtggtgcatacctatagtcccagttacttaggaggctgacgtgggaggatcactcaggccttggaagtcgaggctgcagtgactgaaagatctttagtataatcgtcaaatttttctcatttaaagttagtttctctgctttcccagctcagccctacacagtacaagagcactacacgcttttactccactcctttccaccttgctaaccttgggtggggcaattatgtgctatcagagagcttagacactttcatgactcaaaaaatgtttaggccgggagcgatggctcatagctgtaatcccagcactttgggaggccgaggaagatggatcacgtgaggtcaggagttctagaccagcctggccaacatggtgaaaccccgcctctactaaaaatacaaaaattagccgggcatggtggtgtgtacctgtagtctcagccactcaggaggctgaggcacgagaattgcttgaaccagggaggttgcagtgagccaaggtcatgccactgcagtccagcctgggtgacagagcgagactccgtcttaaaaaataataataataatgatgacaataaagtttaaagctgattctgttcaggaatgctttcaggggttccttgaaagttgggagctctcactccaattcctgtaatgcatctcctctgggaatccagcctccatcctgtcccccttatacctactcttttgggttttccctcatgtggtctcacttctctcaggtggccctcatgtgatctatgggaaacacagatctcttagtccaaaaaactttgggagcactggcagtccatctacacagcaaccttgctttcttttgctgtgctgccaaagcagatagtctctctttcacccctgaaaatttccaggtatgagttagacagacatcaatttactgtgtccaccaaattgcaggagttacacattaagttccccaagtggtcactataaagcccttctatctttactggagggggagtactccccatccctccaacaaagacagaggaaagaggttaggaaagactcctagaataccaacaactgggttaaaaaacgtttccaatttctaacaacacgtgtcaaaaactcttttccaacttccaactttctgaatgaaaccttttacaacaacagatggatacatattagaagtcacgatccattttctggctctcttttgaacacccacatggtgtccttaaaactcactttagaaatatgcatctgttgacttagggtcaaactcagaatacaagagttccacccattttagcaccttatttcgtattctgtattttctaaattttccatgaaaagcaggaataaaataaaaatccacaaccttaccactcagccacggttaacactgtccctttatgccacttaaaaatgtaagtttatattttttaaaaccttgtacaataacacttcatttatataatttcattaagcaatccagtttatcacccaatttaaacacattacctttttcaagcatcaaatttccactgaactagtgtgctgctctttctaaaatgtgtctcactgtgccactctgaagtccaaaccctttaatggctccctaccagagattaaacttcagtcttttaaatagtgtaatctacagtctcctagagctgttacatctctaaatatgattttgaaccatgtatgcaccatataaaatcatactacaagaaaaatgcaggtgtcagaggagttcctaataatgggatgtgatctacactagcggagagaaacatttcagaatttgcgaattcaaccttgtaacccctcaatgaagctggatcctgagatattttcaacaggaactgggaccaaattctgaaatgcaaaagaacaaaggtggctatttctttattagcatgataaaactaagcttgcagtggggatcagtcctcacatgattgcaaataaaattctgtatcactacacatatatctactggctccacactcattatcaccaactgccaaaaagttaatctaatactcaagagcagatttataaaaactttaaatgcctaaaactggatttgggaattaattttgttgtaagttctacacataatgtgctgcattcatagagcacacatttaaaaaattgtcttagagtcaagtggagtggctcatgcctgtaatcccagcactttgggaggccgaggtgggcagatcacttgagatcaggagtttgagaccaggctagccaacatggtaaaaccctgtctctactaaaaatacacacacaaaaaaaaatagccaagtatggtggtgcgtgcctgtaatcccagctacttgggaggctgaggcaggagaatcgcttgaacccaggaggcgaaggttgcaatgagccgagattgcgccactgcactccagcctgggcgacagtgagactctgtctccacaagaaaaaaaaagttttaaagtcatcttttaccagatgaagtgagaagtaaattccatttaaacatgctaccaagaaaaatgcactcatagttcttagctcaaagaggcttcggtctgctaagaagtttaagtcagtaaaaatgcacaaaattacaaaagtccctgcagaaagaaaaataatcagttctctcttaaagctgacaataaatgtattcactcaaaaaagtacacaagaacaatgagcgtaggcaaatacggatatgtctctatgaataaatgtggagagtatgtgtgtgtagtcatctaacatatatatatgcataaagatggctggaaagatggtcaccaaaacagcgactacctaggtggtgatttttgcttttttcttttactactctatattgtttcaatttttttataaatatgagcatgtatgtttacaagaattttcattattaaaatacagtatgaaagctacagtaatcaagccatgtggtactagcagaatgatagatcaatgaaacagaaataaaagtctatagaaaaacccaaacatttgtggtcaactgattaccaacaaagacatcaaggcaattcagtagaggaaaggatagtcttttcaaaaatggttcggagactaccggaaatccacaggcaaaaagttgaacttagtaacttacaccataaagttaacaaaaatggatcatagacctaaatgcaaggaccaaaactagaaaccttttagaagaaaacacaagagtaaatctcataatctttggtgaggcaaagatttcttagatatgacacacactgcaccattcttaacagcaaaaaaaaaaaaaagttaaactagactctaccaagtgaaaatgcttacacctcaaaagacaccgttaacagccaagtgtggtggcacacgtctgtagcatcagttattaaggaggcagaggcaggaggattacttgagccctgagtttgagtctagcctgggcaacacagcaagacctcgactctgaaccccatctcttaagaaaaaaaaaaaaaaaacaccattaagaaaaggacaagtcacagattgagagaaaatatttgcacataatgtatctgacaaaggacctggatacaaaatatataaagaactcttacaactctgtaagaagacaacccaattaaaaatgggcaaaaagacctgacagacatttcaccgaaacagatggaaaaaatggcttggtgctgcatgcctgtagtcccagccctttgggaggctgaagcaggaggatcgcttgagcccaggagttctaggctgcagtaaggtgtgattatgccactatactccagcctgagtgacaaagtaaaatcctttctttaaaaaaaaaaaagaaaaaagaaaagaaaagaagaaaatggcttgaaaagatgctcaacatcattagtgattagggaaactcaaaccacaatgtatactacctcccacccagtagaataattataatcaaaaagataatgacaagtgttgggaagattcagagaaactgaaatcctcatacactactggtaggacataaaatagcactgacagtctggttttggcagtttctttaaaaattatataagttttccatatgacccaataattctattcctaggcatctatgcaaaagaaaacatatgtccacacatatctgcatacaaatgttcacagcagcattatttataacagccaaaaactgtgaaccatccaaacacccatcaactggtaatgaataaacaaaatgtggcatatccacagaatggaatattactcaacaatagaaaggaacaaattactgatacactcaacatgcatgaaccacaaattaaatgaaagaagccagacataaaagatactgtatgttccattcataagaaatgtccaggaaagaataatcaagcaaaagtgagagagtgagggagagagtgtgagaaggaaagagggagacacggggagaagagagagagggagagggagagggagaggaagggaagggcagtgtgtaagagctagaagataggaaagtggatgcctggggcagggggtagtatggaagatgaatacgatttcaagggatcttactgggttaacagacaacatcctagactatggtaatggttgcaaagctgaataaactaactaataatcagtgaattgtgcatttgaaatagatgaattttatagtgtataaagtatacctcaataaaattgtttttaaaaagatggtgaaaaaaacttagtatataattatgtttactgaaggaatgattaggtttttctagatgccaaagccaaaaaccagtgagaaaacaaaacattttaaatgaaaacataaattaaaatagcataccaaaatggcgtacataccacttatccccattatataagtgattttcactttctgccttttagtggaatacttctaagggtcatgattaggtacaggaatttgctacaagactttatgtgcaatgtaacctggatacagtggctaaaactacctggaataaattgttttagggtaccggtacctgtttagccctactttatgacttaggacagtttctataatacagttaaccagttatgcgtttaaaaacaaaactggcgaggtgcggtggctcatgcgtgcaatcccagcactttgggaggctaaggcaggtagatcacaaggtcaggagttcgagaccagcctgaccaacatggtgaaaccccatctctactaaaaatacaaaaattcgccgggcgtggtggcgcatgcctgtaatcccagctactcaggaagctgaggcaggagaatcacttgaacccgggaggcggagcttgcagtgagccgagatcgcaccactgcactccagcctgagtgacagagcgagactctgtctcaaaaaaaacaaacaaacaaataaaactgttcattcatctcttacttatgagaccctaacaagatcctagaagggatctgagagacaaggggcagtaaaagaatttcacaaaaagttccacttgcagacctcaactaggaagaattgtgaagtgcttatatatatatatattttaattatttaaatccataggctaccctcctacccaaactaggcatactgaaaatggtttaaaaactttagttttaataaaacactgtttttaaaagttgcttataaggcatgaacaatgaaaatctgctaaaactaagttcttaaaagacacacatttaaaatgttaatagactactaagaggtcagtgccacataccaaagactgaacactagccagttgtcaccatcgcacataccataatggaactttggcaacccatttcaaaaggttgccaaccaggctacatattttgactactgcttcaacatactgttctataaataaaaagacagagctttagtttaactatattcacattttaatacaggcagttccaaatatcaaaaagactttccaaaatgcttcatccctcattttcagggatccacctgcttttacccactggcaactgagaactagctccacagcaagaagactgttttaagtttccaagtctctaaattcacgtatgctttaacccaaatgaatggaataaatgaagttgacttctccatacttttgaaaaaaactcggtaaatatatttactaaataccaggacacatttagtatctaacatttaaataaaaataaattcaaatataacaaataatattcagcaagttagctttcaaaataacatttttacaagacttgtttacagaaaataactggaagggaggataatttataagatgctaataaataaaatggagccctactcccctaaaaaaaaaaagaaagaaagaaaaattgtgaatttgaacattcccttcactaactatgctagcctctcatttacctaaatctacacatataaagggaaagaagcctccctgaaaatgttcttaatttacatcatttagtttgttggaatttgccagaatttaaagtagagaactgtggtttgatataaagaaagcaaactaatctcacaccttgcatcccaagatggttttctcatatttcacttaaattcaatgtccttgaaattcttaaaaccctgtaatctctttcaaattgaaagacgtatgaacatgtcagtcattactttttgagtaaatgttattaaagtgaccaactcatctttgagaaaattaatctcaaatttccaccaaggtcattacatataactttgccctcaaaaacagattaaaaaatgaacagcaccaataataataatatgtgtcgtgttcttatcacatgccaggaactttttttttgagacagagtctccctctgtcacccaggctagaatgcagtggcatgatcttggctcactgcaacctccacctcccagattccagtgattcttttgcctcagcctcccaagtagctgggattacaggcgtgcaccaccacacccagctaatctttgtattttaagtagagacgaggtttcaccatgtcaaccaggctggtcacaaactcctggcctcaagtgatttgtccacctcagcctcccaaattgctgggattgcaggcgtgagtcagtatgcctggcacttctttaaatgtcagatttaatgaggtataatttatatatgttaggaaataattcttcataagtatcttcttttttttttttttttttgagatggagtttcactctggttgcccaggctggagtgcagtggcgcaatctcggctcaccgcaacctccacctcccaggttcaagcgattctcctgcctcagcctcctgagtagctgggattacaggtgctcaccacttcgcccagctaattttttgcattttcagtagagacagggtttcaccatgttgggtaggctgcttcataggtatctcttttgcatacagtacaagcagaggtaccagctgccctttgctctagagagtatcttttcaagaatgtttgtagagtgaacagtcttgagaaataaagatagtatctccttctggagcaaaggacaagcatgcttactgtctgttcagtataataaatataatgtattcctccagagcaaagggcaggcgtgcttattgctcattagaaaagatctgggttcccttaactcagggcttctctccagtaagaaagcccactgggtgtacaagtactacctggtcctcttcacatcatcctgtagactgaggctcagaaaaccagtgcaaatgctgatactctggctactactattatagagaataataatctgcccttgatctttaacacaggagtttcatgtcttctaccagattccatgaaaatatggcaggataatttattagcttgcaagtaggataaaatctcagaccatcatggttcttgacagttctggggaaagaggatgggatgctgacatagccataactctctaagggaaaggataaaggccctgcagactgagttctgggacaagggaagataccctggaatctgagagtgatcctagtggtggatgggaagaaggtgggaataaagactcccccacctgtttacctgttaatgaacagggtggaattaatgtttagaaactgagcagtgagaagtgaggctgaaattagccacccaaatggtgggttggtagttgttcactatcctctgggctggtggaaggaggggagtatcataacaataagggcaacaagccccatggtcccacatgaaaggctgtggctgtgactgctgagccaaggaatcccctaaactaaaagaaatggtgtaagtaatgatgaccttgctgccaactacagagcttcaagtagaccagaaacattaaactgcgagagaatgacccaaagtgaatataaagccttgattaccagcaccaagttgctctctccccctccacactccctgatccctctctgctcctacccccaaactcttctgctttaatgagcaagatggttaggaatggggctgaggtctccctgatccccaagatggactgaaggccagacatactaggaggtttgcccagagaagttcagggagagactcaaaattttatggttctcttggaaataggcacccaggtaaccattctatctagtcctgtcaggcagacacccagattaagctaatagggtctggacagggtttacaggggttaggaaaataaatgtgacttatgggtgggatgttttggaccaattcaatgtgcttattgttgcctctacatcataatgtatagtaagaactgataagccgggtgcggtggctcgcgcacctgtgatcccagcactttgggaggccgaggcgggctgatcacttgaggtcagaagttctgagacctgaccaacctgatgaaaccctgtctctagtgaaaatataaaattagctgggcatggtggcacgcatctgtagtcccagctactcaggaggctgaggtaggagaatcacttgaacccaggaggcggaggttgtagtgagccaagattgcgtcattgcactccggcctgggtgacagggtgacagagtaagactctgtcacacacacaaaaaaaaaaagaagaagaagaagaagaagaagaacctgatgtgttttgtgcttgtacttaaaagactcacttaagagctagtgagggtttttccaatcagaaagggctgtatgtataaaagtgtactagtacctttggggccccacaaccttaaggatcactttgagccataaagtctcatgatttcactgattagaggatttgacaaaaggaggcagcctccacctacaggtgccccttggggttttgaacgctttacctccctgacacagcaatcaagtttacgccttctgaaaagcagctattagcttgcttctggattccagtggaaattgaatgcctaactcatggaggcctcacgagtctccagcctgatgttcctatttcgaggtgggtcagcttacactcaatgactaacaatgcggtaaatcaatggaaaatgcttatgtgaaacacacctggcttagtcttagccccaagaaggatctcaactttacatgaaaaagggctggcataaatcttaaattataatatcacattatgatatgtcatatcatgataggtcataatatatattatgatacattatgtcatattgcggcaggccaggtctcactaatgcaggcctccacaacaactgtttcagtactgagtggttaaattaaatattaaaagccagtgcccttaaacaaagcctgggattaacaaaagcccatcatgagttttgcctaggcctttcctaggccttaaagcatgacaaaataatgaaggaattcttaagaggacccatttaggattaaacaagttttattatgggtctgaagaaactccctaggcctccactaacaagtttactgggggtccgaaggaattccccaaaccttcatgattttgcaggagacaacataagggtaatcacccccagcaactggacccgtttagattaagtaaatttactgagggtctggaggaggctcttcaggacttagaccttagttatagattaaaagaagttaatcacttatgtatttagatgaatgcacacttacgcatagacatatagcttagaaggcatataagctctggaaaactttgtaattttgagttggtctggcaataatttccaggccttctccctataactggttgcagaaaataaaaactctcttcctctccagttcacctgcatctcgttattgggccacgagaaatagagtgatcctcactttggtccgagaacagtatgacatattacgtcacattatgacatccgggactatgtcataatttctttcttagcaagtgttttctgaaaatgcttgacctaaagtagtattcaggttaatttggattatctgaagacataccaatgtatgattggaaggaataaatattctagatcaatggtccccaatctttttgggaccaggaaatggttttgtggaagacaatttttccacggacagggcgacagggggaatggtttcaggatgaaactgttccacctcagatcaccaagcgttagattctcacatggagcacaaaacctggatgcctctaatgcacaattcacaacaaggttcatgctactatgagaatctaatgctatctccgctgatctaacaggaggcagacctcagggagtaatgccgctcacctcctgtggtgcagtccagttccaaacaggccacggcccaggggttggggacccctgctctagacacagtagaaagggtctgtatcaatctagaatttaatatatatcatacataatgcatcaactaaaatataccaagaagagattactgcattagcagaaaataactgtacaggactcaggcttcacagtgtcacatacaatagtaccttaatgttgatgatcaatcttttcaaaatgaatagctacaaaaatatatctctgcattaagtcttctacttcaacaaaatcacacaatatctttgaaagtagtcattctgacccatggtaccattatcgagatgtgaaggtgtgttgcaagaaatgtttatatttaaataatcaaaattctaagaatgatttctttgtttaaaaagtttacaaatgtgactcatttgcattctaattacttgcataagtgggaaaggggtgaagctatagctgtcaatcctgtatatgcttacaggagagtacagaacaagtgaacattatccatcctccttggcagctgaaaaagaaaaagttttgagatttgctgttttaagtatgttttacaaatacttaatataaaatataagacctcaaattagtaggttgaaatagaatttaagtaaacgtgatgggttcaaatgccagtcttcaacgtctcccacttgggagtatacttgaacaagtatacctaattggaaatatttaattatgattaatggcatacctaaggtctctgagccttactttcctaatgttaattagaaattaaatagaagttaacctacacattacagagttgttataaaactaacctaatggttataaggaatctggcaaacagtaggtgttcaatactacagcgtaattaagagccaggatttagtgaactgatcataatatagaatgagttcacacatccaagaacatttatgtataattgtagaaactctaaatgcccaataaattatttgaattcactgttgttcatgaatgctgacaagatacatatatcaagtgcccattctaagcaaacaaatccattctatgaactaaagtataacacaaaatcatgtctatacttcctcacccaaagatctcaaagcaaattagataacccaatatagcagtcttttttttttttttttttttgagacggagtcttgctctgtcgcccaggctggagtgcagtggcgagatcttggttcactgcaagctccgcctcccgggttcatgccattctcctgcctcggcctcctgagtagctgggactacaggcgcccaccaccacgcccggctaatttttttgtatttttggtagagacggggtttcaccatgttagccaggatggtctcgatctcctgacctcgtgatccgcccgcctcggcctcccaaagtgttgggattacaggcgtgagccactgcgcccagccagcagtcttaaaaatatacaagatacctgaaaaaactacagctcagggcaatcaacatctttatcaaaattttttgccacataattacaaaatgctgttacagtctaagattctttgaccttgccattaactcaattgttcaaaatataattattgagtatccactatgcaccaggcaggcactgcgctaaactctggtgtagttacagaaaagaagagaccaaaaataggaggtatgtcacaaagctatttccaactattatagtcttgttttccttaaacaatgtaagagaaaattgtaggttctcacagttgaatgcattaatacttagaaagagtcaagtaacctcaaataagtgacaatccagtatcttcccccatggagactaggagtaaaataagcacccctctatacttctccatcaattgttatttactatgtaaagataaatgaccatttcaaatatcagtcaaataatctcaagagggacactaatttaacctgtaaatttttaaaacccgtttattcctggagagttcagaaaaatgaattttaagttcgattaagttaaacgtcaatcaaaaatctatcaaaaataaactgcattcacttagttttactcaacatctgaaattatactttttctggggcagctagaattaacttactaaccacgcctccctctgatcaaccaaccactttcttgggagacaaaaatctagcctctacccaattatataatctagaattcatactatatatcctagaacattttacaaagcaagagttccctgacaaacagctacatcactattaaagttttaaagaattcttaaacattattatctagcaaaactgttctgcaaatacacattctctctctctctctctctctctcatgagttaggaaatcttactactgaagtggttatccaaaacctaagcggggacaaacagccaagtacctttttaacaccaagctccccaaaaacgaagctgttagaaaatgctgccataaatacttacagcaatagcaccatcataatgatatgcaggtaggtgtactttaggactaagagcctctcgttcgttattatggatatgaaagtcacatgaaaaaaaaaagtgctgtcatttcattttatgaatgctgattagggagtttcagttaactgcaacactttgcaaacaggctatcaaataaaccccagttatcaagcagttctagacacaaagcttctgtttctattactaaatacaattaaagaattaaaaggatcagtgtgtttttcttgaggtatattagtctaaaataatttgcgatagtaagtcaccaaacacccgagtgactgaaattcttttagctatataaaacactcctttggaatgccgatctcccacaccgtaagacttaaaacacacaaaattcactgacatacatttttcacatagagattaaggggtaaaaaggtggcaaactcaatacacttacacagaagtagcaaaaaacgtgtaagcaaattccaaaaacctttgtcttatccagaatggcactttgtggtactccaaggattcaggcatttcatcagtattccgcacataggggtactcaaacaatgttgctgacagatgagacaacaaagtctcaccaacaaacatttctacagcaatgtattaacaggtaatgttgcaaatcagtcaaggggccaagtgaggaggaatccagaggagtagaaagaatactaattttctgccaaattttacactcagaggaaattaatccatcatagaagtcttccatgaaaaaaataaaaaaggtactcagtatgacccagaatagccatgaggttaaaacacatacacacacacacacagcaattgccacttccactagagtttgacagttatagatttgggtaattatagtagaaattgcgcgtttggaaacacactaagaccacaccctaagactgagaatctggactttaaacgctgatcattaattaaaaggacaacgcagtatctaagttggaagatctggccgcgcaggtggaaggcgaagtgatggggagcgataaagacaccaacttcaaaaccagggaccaggagggctgggtgtcgaggcgaggcgaggcgaagcccgggggataagggggtgtggagctggggacgggaacaggggatgaggagaaaaagcggccgcgaagaggaaggagtggtgggagccaggattggggaggggggacaacgccgacacgggaagggacgagccaacgagccaggagtcactggcgggcgcaggatctggggtgggagggggcggcgagagcgcgcgtggaggtgccaatggaaggaagggggcggaagaaaggaagacccgaatgaatgagcgccgggggcaggccggggccgcggggccacagaggaagcgggcccggggcgtcgcggggccgggggcgggcccagcgcgcctggaaaggaggaagccccgcgccagcgcgggccccgccgcacccgcctcttcgccaaaatggggtcgcagagcaggaaagctaggagtgtgaaggaagaggggaaaatggcaaaaaccaatcactcaccctccgctcgagcctccaggcgctctcagtcccgctcctgcgccctcctggagccgcagaggcggctcctcagcggcgctagggggagccccgggtccggagcgggggagcggcggcagccggaccgggagcccctcaacacctgcccctgtggcagagccgcgacaagccaggcggcagctccgagcggggagggcaagtgacccggatgtacagggtaacgacggggagggggaggagggaatgccaggaagtgagggcgccgcggacctgtccggccgtgcgcatgcgccgcacgcccgccccgcaaggtaaatccttagcctatcttctccgcccctcatccccgcccctcccgaaggggcggggcgaagccagagacaggtggtcggcgggcgcggcgtgcagaggaaggaggcgtggccacccccttgcaccccggcctccttaaaggggcagcaccttcgcaaatatcgcgccgagatagcttctgagtgggttggggtcttccagccttccagatgtacagatgggaaacggaggttcagaggtggcggtgacctgcctcttgtcagcgggcttggaaatggcaggaactggacctcgggactcgatgctgagccctgcgaagttgccatattccccccacgcctggaaccgctaggctgcgggcgcgcctctcccctttgggtcaggtactgagcctcgcccgcgattcccggcgcggcacgtgttcctggcaggcgcccagcgccaggagactgtactgttaccgcctgcgatggtatcgcggagacgcccttgggtggtgaaaaatgatcattctgagaacaaaaattagactccacttacaacactctcagatatatcagacccctgttctggggtcgactctgggcaaaaatatctagtgggcagaaacttggatgtgacagagggcacagcctcttaattacttccctaattcccctttcactctttgaacataaatgatccctttccctttacagacaaaaacagaacatcccatctagctagcttctcctaatcctgttataaagctgaatttttttttattaacattaaaggggaaaagatgacaatgttatctctcccagggttgttttcagtttgacagctgagcagatcactaagatggaggtaaatgattatgaacattttgcagtcacaggcccaactgaaaatactgtaacagtatggacttttccccccgggaaaatacagacatgcacacacatttgcataaaatttcaggagtttcatgcaaccagggagcctatccatgaaatcctgattatgaacgaagctctagtcaaagagctaaggttccggtaactatctgcgccttactctatggggccaagaaatcactccttgccacaaaacacagaagggcagcccttaccttagcctttttgtcttcctcttgagttatgtagaaaccaaatggtatgtaacatggtgggcatattacttagaaacgtgttgagtcatggagagatgaagtggctttttcaaggcacacactaagggcaacattcctaggcctcagacttttaccttaattatcatacttcaggaggattcagggattctatattgtagctattataattctggtcaatttcaatgaaactgaaggagatttttttttttttttttttggtgatggagtctcgctgtcacccaggctggagtacagtggcgcgatatcggctcactgcaacttccacctcccaggttcaagcgattctcctgtctcagcctcccaagtagctgggattacaggtgcacaccaccatgcctggctaattttttgtattttagtagagacggggtttcaccatgttgcccaggctgctcccgaactcctgagctcaggcaatccacctgcctgagcctcccaaagtgctaggattacaggcgtgagccaccgcccccagctggagatgatgttttacaaatgttgatgctgatagaaaagtcctcctaatccaagaagcttggtccacttgtctgacatactgacgtccaacctcagataacctgggtccagatggatcactgtcctcaatgtgaacaggaggaggagttcatacatgtgcaaagtcccttagatatgagctctgagtaaccacacacctctaaccctatctcccaccagaagcagaaatctttcatattatcttcaacacatgaatatctagttcagctccaatatctccaactacagggagctcattactgcaatcatcagcctttgattgtgaggaacctcttttacactaagcaaaaatctgatgcacaacaattttcatccactggtcgtaattttctctatggagagcaatatagacatgacgctggcctagggagcttacagtccagcaaagaagcagtccactgagaagtgataataataaaatactggaccaggtgcagtggctcacacctgtaatcccagcactttgggaggctgaagcaggtggatcacgaggttaggagttcgagaccagccaggccaacatggtaaaaccccatctctactaaaaatacaaaaattagctgggcgtggtggcaggcgcctgtaatcccaactactcaggaggctgaggcaggagaatcgcttgaacccaggaggtgaaggttgcagttagctgagatcttgcctttgcactccagcctggatgacgagcgaaacacgtctcaaaaaataataataataacaaaatacaatgagtcctgtgaggaacacggaatacccctctcacatgcacctttctccttagctgccctgggtccattcctgccatgtacaagaactcacaagtaagttcttccattaccccacatgggaattccctaaaagagggagctggctcagaaaacaagactcctataagaagtgctgaatttattcttctataatcctttcttcatcattctgcatgaatgtgatcatatttttgccgagggcaaagctttcaaagacttatgttgaaaaattgaacaaaaggatgcaaaaaaaaagggcttacataagagcactagtctcttaatgatgatttacgcattgtggctagctgtattttgtgagtccttacaatgtgccaggcactgtactaagctctacgctcttgacttgttttcttcttttgctttttcacagccatcctatatggtactattatcaggcccattttataaatgaggcaaccgaaactccgtatgtgacagatgcaggattcaaacccaatctgtcaacttcacagcttctatggacactgcattgtctctgtctacttttttaaatttcacaaggtcctgtggctttccttcagtgctgttttcttggaaatttttatttattattaaatcagttttaaaaccctatagagaataaatggtttcactcaatcattgattcactcaatcaacacacatttttgcaccgcccacccgcccccccgcactgtgtcctaggcatcaggctgagggtctgggaagaaggagagtaagacaccaagtccctgctccggaggggctgagagtttagtgaaaggacaggctgtcatcttgcacttaaaacaaagcatgactcgttgtaattcagaagggtagaggaaacagctttccctgggacaattgtgaaggcttcagaaagaatgggacctttggccaggtgcagtggctcacacctataatcccagtattttgggaggctgaggcaggcagatcacttagggtcaggagttcgagatggcctaactaacatggtgaaaccccatctctactgaaaaaaaaaaagaaagaaattaaccaaacatggtggcacgcgcctctgtaatcccagctacttgggaggctgaggtgggagaattgcttgaatccaagaggcagaggttgcaatgagccaagattgcaccactgcactccagcctgggcaatagagtgagactccatctttttttttttttttttttttttgagacaggagtctcgctctgtggcccaggcgggagtgcagtggcgcaatcttggctcactgcaagctccgcctcccgggttcacgccattctcctgcctcagcctcccgagcagctgggactacaggcgcccaccatcacgcccggctaacttttttgtatttttagtagagacggggtttcaccgtgttagccaggatggtctcgatctcctgaccacgtgatccgcccgcctcggcctcccaaagtgctgggattacaagcgtgagccaccgcgccccgccgagactccatcttaaaaaaaaaaaaaaaaaaaaagaatgagacctcttagcttggtctttaagggaaggggaaagggccaaggagaaaacgcagggggccaagggttggcagggattgtgggggtgctgtgacacactgagattgtaaaggacatcatacaccatactaagaaatttgaacttgccttctgaaggcaacaacaagtaaagagacgcttctaaccaagggagacacataatcaggtatgttttatatcaggatcactctgaccacagggtccaatatggactacagtggtagggagaacagagggccagcaaagcagttaagaggctgctgtggggtccaggagagggataaggagagcctgctcaaggaaactggcagcgaggatgaagaacaggcaccggaattaagatgctacctgatgcagaatctgcaagttcaatctgggggaagaggagactggggttgtcgggatgacccagaggctcctggcttagcagacaaactggatggtgacaccacgtgatatcaatacttttacacagttttcattcctcttatcttccaatctttatccatgtaaatgcacttgctttgccgggcgcggtggctcacgtctgtaatcccagcagtgtgagaggccgatgcaggtggatcacttgagtccaggagttcgagaccagcctggccaacatggtgaaaccccgtctctactaaaaatacaaaaattagccagacatggtggcacacgcttgtattcccagctattctgaaggctaaggcaggagaatcacttgagcccaggaggcagaggtcgcagtgagccaatatcccaccattgcactccagcctgggcaacgcagtaagactctgtctcaaaaaaaaaaacaaaaacaaaaataaataaataaatgcacattgctttcattggtttcttcagatatgtgcaactctttcccaatactttttcatatttctacacactcacatctatcattttaatgactacagagtatttcatcatactgaaatacctcagtttccttcagttgctaaaggtccacatcctacatggctggtttaccctctagactcatttggctttgggtattttgcaagggatgagttgagcctttagggaaaaagagcctttaggcaaaaggtgttggagaagtgtggcctccggggaagctgcaactctcctgggaggggcctgggcaaccgcattgctgtattgcaggtaaaaaatgcggaactatggaaaagaacctgtcatccatggggagcctgaggtccaagtttccacagaagctggttttcatgtcctaactccctaatccatttgttcattcatgtgttcatgtattcactccttctacaaagcattcctgtgaatgcagagggcaacacagcagagctgaaaccatgtctatgctctggatgtaacttaggctctgaaacctgctctacaacttacacaagttattcaacatctgaaagcctcagtttcccccacaagtttgttaactcagagaaaacttgtaaaatgctagggactgaactaggcacagactaagctcaataacagttttcagtcttggttttctccttatgcttttttgactcccaccactgtaccttgagtttcttttttttgtatttttatttatttatctatttgagacagagtcttgctctgtcgccccaggctggagggctgtgacacaatctccactcactgcagcctccgcctcccgagttcaagcgactttcctgcctcagcctcctgagtgagtagctgagattacaggcatgagccaccacacctggctaatttttgcatttttaatagagacagggtttcaccatgttggccagactggtgttaaactcctgacctcaggtggatctgcccaccttggcctcccaaggtgctgggagccactgcacccagctgtaccttgagtttctgaccaaacccactgggtagccatccatgagctgcagctcaggtcctaaatctgccagagtgaactagacccactcacttgatctttgcttcctatctgtgaaatggagataagacaatctacttctcggaaatgttgggaagctctcatgaagactgtataagaaaatactttcaaagctccaaagcactatgtcattattgactgttaacttttgttagagacattttgttttctttgtttttccctttaaaaaaactctgacctcagcgtaagctccctggattgtaattactgggtcaaaggatctgaaaattttttagatcctgatttgttattgcccaattgtccttagagaagactctatattttgctgccagccttcactcaaagacatctttcaatatgcttcagcacctagagtatagtttttgctgcctctgtatccagtctcgctcctcaattgaacattcagggagttctatcaactgtttctctcttccttttcacaggatgaatgaacactgaatcctttagaaaacagctccaaacatttccaccatagtcagggactccagtgttgccttagggatgaggactccatggatatttaacgaagaaaggggaagaggacaggggacagaggcctgagaatcccctgggaagggctagaagctcatccagcattgaaagatgacatcagagccgctattcaaaaagaacccaagtaagaaggcaaccaatcaaactgacaccttcctgttatttagcaaaacattaaccagtctcacaggagccataaagctgtccttagagccatatttcccccgagttataaggtttatctatgagcctccggcacatctgcaaatctaacatatttctcacaagtggggcaactccaagtctcatttccccaacccttcaggtgacctgcaggaagaaaaaagggtgccactgcatcacattggctgttcccttctgtacctcaagtacactttccagtctcttcacttggctgtttgtcagccttcggattcaaagcagttcccccatcacccttccaaaggtgaaccccccatcacccttccaaaggtgaaccccacctaccttcactcattccctagcatgtcactggtgtttttccttcacagcgcttatcacaaactctaattcttttatttatttatttttttttttgagacagaatcttgctgtgtcacccaggctagagtgcagtggtgcgatctcggctcactgcaacctccacctcccaggttcaaatgattctcctgcctcagcctcccaagtggctgggactacaggcacatgccatcatgctcagctaattttttcatatttttagtagagatggggttttgccatgttggccaagctggtctcaaactcctgacttcaagtgatcctcctgcctcggtttccaaaaatgttgggattacaggtgtcagccactgtgcccagtctctaattattttacatttttagcttaaaaatgttttaactaaaaaaaccccaaagaaataaacaaccaaaaaccacctcttgttacaatgtcagctgtgatggcagagacagagctatcaccatgcccactgcagttcctgccatggtgcctggcccctaggagagcctccctaaatatgttgaatgaatggataaaaaaagggaggacccgagcagtaaataaggtgccccgatgcactattcaccctgattatatgagtaatacatattgattgcagcaaaaaaatttgaaaatacatatgagcaaatgaaagaaaaaataaacacccatgatccaaccacccacaccatgtggacacccttccaaatgtttttcctgtctatatctatataaaggcagcacatatttttattaaaatggttcatttactgaattgtaatctgctgtctttccacctcacagtttatcaacctttcttaataaaggaacgtcagccacatcgctgttaaaggctatataacactccgctgtgcagctcaaccatgaagtgttgaatgattctggagttcagctgaagggaggtttcttcaatgtcaataaaggtaaaatgctttattccagcacttcccccttgccaagcttcccattttttccctctgtgtttgtattgctttagagctgtatttctacagaactgtattccccaccgcccattcaccacctggagttattagagtcctcgtcaactagagaagcaaaattgtttgcagccggaaaagctgatgtatgacgaagcaaggacgatgccttgaagttcaaattgggaatgtgctgctgatacaggaaacagaaatgaagagtgtgctttcttgccaagatttgaatagggagaagaggaaaagattttctgcacgccttcacttcttcccaagccctaccctcgaggagaggtttttcccaagggataggctgttccccaccatgctgactgatgctgtaagcagtttgcagaccaagcccatggctccatttacagactcactggctgcaaaaaaaatccaagagggcatgatcagaaggttccaccccttccacaaacagctctttcagcccctggtgtggttcagcagcacgaaggactgctcacttggcatgtttagctctgacaatcccattccttccatcaggaaaaggcacaggcacaggagggcgccacctgaaggaagggacaagatgccataaaatcatagatggctccagaggaacggaagggagaaaaagggtgggccgttcacttctgagcttcaccccactgtgaccccaaaacctatggagaggttagttcatctctgcttttccacccaccttacatagcataccatcagaattaaatctttgcctacagaaaaagagaattccagccaggtgtggtggctcacgcctgtaatcccagcactttgggaggccaaggtgggaggactgcttgagcccagaattgcttgagaccagcctgggcaacatgaggagaccctgtatgtagaaaaaatttaaaaacaaaggaaaattagccgagtacagtggtgtgagcctgtggtcccagttacttgggaggctgaggcagtaggattgctttggctcaaaaggtcaaggatgcagtgggtcgtgattgcactattgcactctggcctgggcgacagggtgggaccctgtctcaaaagaaaagaaaaagagaattcttaattgtgtctatagtcattaattttcaatgacattttaaaagattgataaagtgtattaatttatcaatgccattaaaaaaagatttgttgttttacagaaataccatcattagaagacaaaaggatttaatgtgaaatataatgacagaagaactattaccaccaatatctctgatcaattgcttagtttctgccattattacagaaagtgatttctacccatttataatgcaatccttacaacattatgaaagatattttattacttccctgttttcagatgagaaaatggagggacaaacagttcaagtactttgccataggttacatacctacgaggaggtgaaccaggattctagaccaagtcttagctccctgctttgcataaatcattccacctgccttgcttctccagcccgttttcctttctgtaaacattaactaaatccctcagtgaccaagctccacctgaaatactacactaaggctgggcatggtggctcatgcctgtaatcccagcactttgggaggccgaggtgggcagatcatttgaggtcgggagttcgagaccagcctgaccaacacatagagaaaccctgtctctactaaaaaaaaaaaaatacaaaaattagcagggcgtggtggtgcatgcctgtaatcccagctactcgggaggctgaggcatgagaatcacttgaacccagggggcagaggttgattgcgccattgcactccagcctgggcaaaaagagcgaaactccatcttaaaaaaaaataataataataatacactactcatctataaaacagccacaattatcacctacttcactgtgttattgtgagcactgactacaataataggtagaacttaggaaattgccaattccaactgtctttggctataaaaagcaacaattacataggaaacataatcagtaaaagtttgggtaaaacttaaatgtttggtaaactcttaaataaatgtatgtacctgattatcttggcttttgacatttgcttttttttcttttaatttgagagtttggggcatttttgttgacaattgctgttttaatattcaaactcgcaaagttgtgtatgatagaagctgacagtcagaccccgggcttggtcagccttaagttttaatcccttcattttctcatctataaaataaagacagtgtccgggcactgtggctcacgcctgtaatcccagcactttgggaggccatggcagacggatcacctgaggtcaggagttcgagaccagcctggccagcatggcaaaagcccatctctactaaaaatacaaaaattagccagacgtggtgacgtgcacctgtaatctcagctacttgcgaggctgagacaggagaatcacttgaacccaggaggtggaggttgcagtgagaagagatcacgccactgcactccagcctgggtgacaaagcaagaccatctcaaagaaaaaaaaaaaaatgaagaaactaatggtactcattgtcagatgtaaattatttcatgtagagtacttagcacagggcacagaaaatttaagagctcagtaaatattaacattttctattacttattattattgtttttattaacagacttgctttcattaagatgctgttggtataaagctgcccactgcagcattatttataataaaagccagacacaaattaaatttcccactatagggaaagggcatagtaggattctgaaagaaccatctttagaattaatgaaaatcactttaattacaatgtaagcccctgctttgctacttgggggcagtacgattttgagcaagtcatttattttctctggacctgtttcctcacctcagaaatgaagggtttgctctcaatgactcccatgtcttctcatgatttaaagttacatagtcctggccagacagggtggctcacgcctataatcccagcactttaggaggccaaggcaggcagatcactcaagtcaggaacttgagaccagcctggccaacatggcgagaccccatctctactaaaaatacaaaaattagccaggtgtggtggcgggagcctgtagtcccagttactcgggaggctggggcgggagaatcacttgagcctgggagacagaagttgcagtgagccgagactgtgccattgcgctccagtctgggtgacagagcgagactccatctcaaaagaaaaacaaagcaaaaaaataataataaagttatatagtcctaaggttctcaatacattaaaatccatcaacctcaaggacaacatacaactgaggacataagaaaatggtagaaacggccagttgcggtggctcatgcctataatcctaacactttgggaggccgaggcgggcagatcatgaggtcaggagttcgagaccagcctggacagcatggtgaaaccccgtttctactaaaaatacaaaaaattagctggccgtggtggcacgtgcctgtaatcccagctacttaggaggctgaggcaggagaattgcttgaacacgggaggcagaggttgcagtgagccaagattgtgccactgcactccagcctgggtaacagagcgagactccatctcaaaaaaaaaaaagaaagaaaatggtagaaacacaagaaactattttataaattaatattcccaatcttctttcaccctactctttgtttccataacatttgtcacctcctaacatcgtttgtattatgtttattgtctttctccatgaactagacctaagcccatgacagtaggcatttatggctggtctgtccacgaatgtgtccccagcccctagaacaatgtctggcatatagtaggagctcagttagcattcattgaatttaaaaatgtgaatattaagttaaaagaacaaagtacaaaactacatatatcataaaatgcaaaaattaccttttgtttttgtttattttttttgagacagagcttcgctcttgttgcccaggctgaagtgcaatggtgcaatctcggcttaccgcaacctccacctcccaggttcaagcgattctcctgcctcagcctccctggtagctggaattacaggcatgtgccaccatgcccagctaattttgtatttttagtagagatggggtttagtagagatggggtttctccatgttggtcaggctggtctcgaactcccgacctcaggtgatctgcccacctcagcctcccaaagtgctgggattacaggcatgagccaccacacccggccaaaaattacatttataattatgtatattacatgtatatgtatgtatacaataaatacgtaataaagttatatataatagaatgcaaaattgtatatacaattaatataaaatatgtacccctatggagaaatggtagagaggatcagagaaggtaaaactcaatgataacaagatgaatgtggaagtgaaataatattctttttcatttttctttaacgttttgaaccattttgtttgtccaaaaagatggcattttaaaaaggaagagtgtgaacaggagaaatatggaagagaagaggaagcagaagtggccaagggagagaacctgatggagaaaataaggaaagataggaggggccaaagcaaacagaaggctcatggctggtagttactctattaatggaaatagaatcacacaggcagaaagaaaagtgagtagataaaggaaagacaatttaccttgaacttttaattccaagctaatatctattaaactactcctaggttgatagaatttccccccattaactgcctcaatccacagaagctttggtaaattttagcacaaaggaacacttggaactgttacgtgttactgttcttcattccgaaccttctgttgatcagctgctttggaggcaagaagaaagaggcccacattctaagactaactgaatgccacaggcattttcattagccaactgatccatcaagcatttcatctagggtcacctacttgggggacatagagtgtaggaaacagacttgtcttctaggggatgaaaggcacactacttactccaatacaaagcaacgcacaactgccaaataaatgacacggatgatatatcctgtaaaattaaagggctagaagagttccttccagcttgggaaggtcaggggagggtggcagggagatgtccagggaaggacttgtcctgcactttatccaataacagggaccctagtgctgttcgtgagcggactcttgaccccttcacctggtcccaacttgtacttgagatcacttgctgctcttaatgcctagagcccccaggtattggcctgggttcctcatcacagccatgcatttgccattttgagcaaaccaggtcagatcccctgtgcacgtgctctcaacctctgtgcttcttgtttacagcacacaccatcactgcaattgtatggttattgtgtggttccttaaacactgtgagctccaggacggtagcggccacactattttgtcaccactgtatccccagtgagagcacggagcctggcacaaggcgggcactcaacaaacagctgcagctggtcaaggagatggcattggtccagcctgaatcagcacaggcctaggttttaacgctactgtgaatccccagcatggccacagagctggaaccagggaatcagataagcaagacaaggaggtaagattgaaccctcgcccaaaattagcctaaatgatcaggtcactactgtgtaacctagtatttgaaatacagagatttagacagaatgacaggaaaaagtcaaacataaactaaaagtccgaaagagcttaggttctcacagtcactttttgaggctacaaaaggaaagatattgcataaaccttaaaaaaaatggaccagttaagaagtgtaactggtttagcaagcttcccttctaaaatcctggtgccgatttcatgttagaacacaggtttaatgagaacgtatccctctccccaagttgtaatacacagaagagggcaaaggggagaatgttaccttgcccaagctctggtcttatctcaacccacagacttggagaaaatgtctatagtccatttcagtatttacttagctttttaatttttaattttttttttgacacagactctcgctgtgtcccccaggctggagtgcaatggtatcatcttagctcactgcaacttccgcttcccaggttcaagcgattctcctgcctcagcctcccgaatagctgggattacaggtgctggccacaatgcccggctgatttttgtatttttagtagagatggggtttcaccatgttggccaggctggtctcgaactcctgatctcaggtgatccacccacttcagtctcccaaagtgctgggattacgtgcttgagccactgcgcctggcctagttttttaatttaataggctgcttgtacttataagtgcctgcatcagagtttctggatgaaatgaactaattttagaaatgggaaaaactttggaattcaccttcaatctaatatttttgcttatgaaaatgcagggcccaagtggttaaggaacttgtctaggggcacgatcccccagtcatgaactctggacccagggggaagattagagggatttatgtctatactgtctttatttccaaaggttagtctacatcactgaggcatcagtaaagtcctgtgaaatatctatactaataagcagtgtgcaacatttggtatggtatctggtgtgatctttcagggtaaaagtaggtaaattaattgctgtccttatttggcccttactacacacaacacacaaatctcttccaccattgcaaaatgttagaagatgtatgtgctgtggccggacgcggtggctgacacctgtaatcccagcactctgagaagctgaggcaggcggatcacttgagtttaggagtttgaaactagcctggccaacatggtgaagtcccgtctctactaaaaacacaaaattagctgggcgtgatggtgcacacttgtagtcccagctacttgggaggctgaggcaggagaatcacttgaacccaggaggcggaggttgcagtgagccaagatcgtgccactgcactccagcctgggtgacagaacaaaactccgtctcaaaaaaaaaaaaaaaaaaaagtatgtgctgcatgatgaagaaataagtggaaatgcaggctttctgagattttccagtcacccataatagcaaggaatggtatctttctcggtcacaacactaagctgcttacagagttcatgtaaatactgtttcttgctgttccacctctgctaggaacaccttccacaacactcccacgtttccgcaccaaactcctacctacacatcgaggctcccatcagaaatctctacagacgtcggaaatctatagagatattagataagcatttcaaggtaacttatttcctcattttaccttatggtaacagccctatttacctcttacaagcgttctacggtgtatcaaaaagaccaacaacagtaagaggtttgcatagcactgtgtattccattgagaaaagtgctacaaaaacacaagatagcattttattaatttattaaatctgattccttgagacacatacaaagcggtgttgatggatgaaccaacaaacccaagattaatagcctggtttactgcactcttttctccttccaagccacaagccaaaataaactcaccctcaatttataatgttgcaaaatgtgcttctaagcaccaatgcctgaatccactgtggttattaaaaggatggttgcatccatcgggatgggataggttatgctgtggtaacaaagaacacctaaatctcagccctaaggatgaccacaatggtccctctggggtcaagaaggtaagcccagcagccccatctttctcattttcacctgacaatctggttagccaactctgtggcttacataagtttgaaagatatgaccctctcctttccttctccaaccacctacaaaactgtctcgtggagcgcagtgagaatcagaagtgattatctttgtaaaacatcgagaatgctgcctggcatataggtagcagccagtaaataataatgatggctactaccattgtcacttccattatccccaccccttctcaaataataataataatgatattataattctcacagagcagtgattcctgaacttaacttgtcctgaacattagaatcatctggagagcttaaaaaaactaatgcttgtgtcccacccctagagtctatgaagtaattcatctagtgtatgaccttaggcttgggattttaaaagattgccaggtgattccaaagtgtagacaagtttggaaaccagcctcaagaggcagcaagattcatatatacacatacatgtctttgtgtttgcacacacacacacacacacacacctgctcccaagttccatgaatcatgctccctgtatgacagtagtggttatatcacttagggtgagctgggttatgctgtggtaacagagcccctgaatctcatccctaatgaaaaccaattgatcacccctgcagggtcacaatgagcccagaagccctgtttttctggtctttacctgacagttaagcctattcttttttctttttcagtctttacttgacatttaagcctatttttccttccttccttcctccctcctccctccctccctccccccagcctctctttctttctttctttcttggctcttgctctgtcacccaggctggagtgcagtagcatgaccatggttcactgcagccttgacctccagggctccagtgatcctcccacctcagactcccaagtagctgggactacagacacacacgactgtgcctggctgatttttgttcttttcttttctattttctttttgtgtgtgtagacacagggtcttgctgtgttgctaggactgacctcaaactcctgggctcaagcaatcctcccaccacagcctccctaaatgctgagattacaggcatgagccactgtgcatggcctaagcctctgcattttatcctcagacctttctcatgttctattttcttctacttcatacctttccccaagtccaggtaaagtttgcctggcccagagtaaatcagcacccaaagatgacaccaatgtggacagacttaggggaaatctggttagaagaaggccactaaaggctatcagtacttaaggctgtactttgctcaattctctgtccccaagacttaaaacacagcacacaatgtggtagaaatttggatagttaaatcagttatcatcagtaataacctagaagaaaagcagacacaagaactcaaaaagcacagcatctaagctgaaaaccttatttatcaacttgtcaccaaccaccatttgaatttcaaatttttttattgccggcacgatggctcacacctgtaatcccagcactttgggaggtggaggtgggcggattacttgaagtcaggtgttccagaccagcctggccaacatggtgaaaccccatctctactaaaaataaaaaaaattggccggcgtggtggcacatgcctgtaatcccagcactttgggaggccgaagcaggtggatcatgaggtcaggagatcaagaccatcctggctaacatggtgaaaccccgtctctactaaaaatacaagaaattagccagggatagtggcgggtgcctatagtcccagctacttaggaggctgaggcaggagaatggtgtgaacctgggaggcagagcttgcagtgagccgagatcgcgccactgcactccagcctgggcgacagaacgagactccatctcaaaaaaaaaaaaaaaaatacaaaaaatacaaaaaattagccaagctaattagccaagtggcacacgcctgtaatcccaactacttgggaggctgaggaatgagaatcgcttgaacccgagagatggaggttgtagtgagccaagatcgtgccactgccctccagcttgggcaaagagtgagactctgtctctggggaaaaaaaatattaatttctccctggataaaattgtatctgctggggtggaatggaagtaggtgaggttgggggacctatgaagaaaaaagagcctttccactgggcagtgaagtgtgtacacacacactgggggcagagcagtgtgaaaacattctgcaccagcacacaaatgacttttggcaaatcatcttcctgatctgtcggatgttacgtctctgcagaatctggagaaaaccagaaaacccagcttgtttgccctcattttggcagtttaatttaggaatcacactggctttacataaactctttaccaaaaaaactgtattctgtattttgaaggcacaagttaacatgggcccaagggaaggaagcattgtatacaattacataatagctactctattactttaaaacctaatggcagcctcgggcagaaaagtcaaaaggggagagaaaccatttctgtgaaattatctgatgcaatcatctctttggagacattgtcagttgacaatggttctgctttttctctcgagctcattcaatttctgttatttacctgaacctggaagcagagttttcctcccatctaccactggtttaaaaaaaaaaaaaaaaaagaggccgggagcagtggctcacgcctgtaatcccaacactttgggaggctgaggcgggtggatcacgaggtcaggagttcaagaccagcctggccaagatggtgaaacccccgtctctactaaagatacaaaaattagccggctgtgatggcgggcgcctgtaatcccagctactcgggaggctgaggcagagaattgcttgaatctgggaggcagagattgcagtgagccgagatcatgccactgcactccagcctgggcaacagagactctgtctcaaaaaaaaaaaaaaaaaaaaaaaaacaaaggcaggcaggatttctctaataaaagcttgaaatgaaaagcagtaactactcccaaggccctgcttattgtagaaaagtcattcaacaaatctttttaggtctctattaacaatttattttctctacccccatcacaaaaaagcagaggaagtagtgtagcagccccagccacagccacagccacaccccactacttgcttcctaggtgtgtgtggtgtgtgactgcctgcaagcaactccagctctctgaacttgtttcctcatctgcaaactggaaatatttatttatttgacaaggacattatgagaatttactctgaaaaatacatgtagagtacctagcattcaattaagactaggtgaatgcccttctcaggaaccgtactagagaaggtgagtttctggtccagtgtgatgactcacgcctgtaatcccagcactttaggaggctgaggtgagaggatggcttgaacccaggagtttgagaccagactgggcaacttagcaagaccccatctctattattaatattttaaaaaataagaaaaaggtgagtgtctaataagagataatacttttacccatctttgtacgccaatcctaccacatctactccactccttccccatcaagaggcattcttcagtcaggcacaccttacctccaattccaagggcaggtcctgaatggtctaagccaatcagtattatcccatttcccaccacaattaattgaaagatgaatgcatgtcctgaaatgatccaatcaggacaaagttcaggaagtttgttcagtggctctagggagagatggtagctcttttctctcacgactatgaaggaagtcaatctgagaagagcccacagacagaagtacagagctgggaggatcttaaggaaaggaagacggagccctgacctatcctacctctacaatttttggttatgtgagccacttaactgcttttatcaattatcccatttgaactgggatttatgacacttgcaattcaaagcatctaactgatacatcctggtgcatggctgaataaatcactgaatgaaagactgcacacttccaattatttaactcagactttaagttccctgggagcagaaaccctggtcaatcttggtcacccagggccaaacagagtttctgtacacaggccctccttaagtactttttaaaataaatgaatgaaatgaaacttaacaaatcacgatcaggcgcagtagctcgtacctgtaatcccagcactttgggaggccaaggtgggtggatcacctgaggtcaggagtttgagaccagcctggccaacatggcgaaaccccgcctctactaaaaatacaaaaattagctgggcatggtggcgggcacctgtaatcccagttactcaggaggctgaggcaggagaataggataatcgcttaaacctgggaggcagaggttgcagtgagccaagatcgatcgcttaaacctgggaggcagaggttgcagtgagccaagatcaagccactgctttccagcctgggcggcagagcgagactctgtctcaagaaaaaaaaaaaaaaaaaaaaggctgggcatggtggctcatgcctgtaatcccagcactttgggaggccgaggcaggcggatcacaaggtcaggagttcgagaccagcctgaccaacatggtgaaacccccatctccactaaaaatacaataattagctgggcatggtggcacgcacctgtaaccccagctctcaggaggctgaagcaggagaattgcttgaacccgggaggcggaggttgcagtgagccaagatcatgccactgcactccagcctgggcgacagagcaagactcagtctcaaaaaaaaaaaaaaaagaaagaaagaaagaaagaaactaggaaacttaccaatcacctcacatttcagaagctttgaaagccctactccccagacctacctggatcaaaggagggtcaagaggaagcccatatgattttggagccatcagacagggctgggctcaaatcgtgactctaaataagcctcggcttcttcccctgaaaaatggagacaataatacctatttccctgggcaggaggagccatgtcaaagaaccagggggaggtctcattcaagaaatatttatttcccccctgttcagctaaccctacttcattccatgggttctgctctggggttcagaaacgggagtcatcatatggacagagtggtgggacacagcccagatcacccagcagagccagccctgggaggatgagaacaggtgaggcacaccctaagcctcccatacctcaatatccatcagtccctttaggagcagcatcctaggcagacagcatagataaaactgggccatccagcttcttggttttgctggttgcctccttacagaggggtgggactagtgcaactcccattatcatagatctgtacaaccttagaggctgtcatttaaccgtttagaagtaatatggaacttggccagactgtaagctccaagagggcaggggcttgaatcattcactagtccatctctggtacccaggtaggcaatcaatggaatatttcctgagtacatgagtgaagatgaatgagtggataaacaaatattgatgaaatcaagatctcagaagagaactatggcaaaaccctattatttagtacagtctgctggctatgcagcagctaaatcaaataccaggcaatgcaaggggcttctgaaactggcagacctagactgaattctggccttgtcagagcccaggcctatgacctcgggcaagttcctaaactctctgagctagtttctttaacaaacacaattatcaagattaaataaaaattttttaattgcggccagatgcagtggcttgtgcctgtaatctcagcactttgggaggccgaggtgggaggatggcttgagcccaagagttcaagaccagcctgagcaacatgggagaccccttctctaaacatacaaaaaattagccacgcatggtgctgcttgcctgtggtcccagctactcggggaggctgaggtggatcacctgagcctgggaagtcaaggctgcagtgagccatgattgcgccactgcactccagcctgggcaacagagtgaaaccctgtttaaaaaaaaagaaagaaagaaagaacaaaagaaagaaggacagaaaaagaaaaaaaattagctaggtgtgatgtgtgcctgtagtcccagatactcaggagggaggcaggatgattgcttgagcctgggagactgaggctgcagtaagctagaatcataccactgcacaccaacctgggccacagagcaaggccttgtctcaaaaaaatgaaataacataaattaaaataaaaataaacgtggggtgatgtcaattaaagtgtctagcccagcatctatggcataaaatagggacccagaaaatgtcccttccctatgaatgccctttacgtttggaaacagctatcatatgtctcccctgtctcctatttcttgttaaatatttcagctaatttaatggtatccttaaatgacttgatttcagagccctcttctatccctcccctctgcaaagtctccatctgttaaaaccccactcggggtattgcataaccagctcgcagaatcagcagcacgctcctgtttgctcattcatctgttaattcattcactgagtaaacactgattaaaaacctactatattggacatccttggcttttgcctacccaccattcacaaacggtacccgcatttccctggaaacctgcaatctttccctcattctcagtctctgtacctgagcaggtgcaagctgcacccaatctccctcagggggagggcatttgatccaagatggccaatcagagcgtcgcatttgcctgccacagcgattggttcagggctgtgcatgttacccagaaaagaccaatcagaaagacagttggactcagttctaagacttgttgaactactggaacagtggcctttttttacctcctgctagaaccgctgacaaccattttggaccacaatccacaagaaaagggaggcagcgttaaagatggtgaaaaactgtgtaagccttggcaacactttaagccttggatcctccaggccttatgtttcactcctagattcttcaattacataaaccaacaaatcccctttctgcggaagccagttcgaggcgagattctgtttcaaggtcgacagaatcctgactaatgaaatccgaagtgctgtggtgtatgctgcatgctggctatacacagatgaagcaaggtgatccataccatccttccaggcactcacaggctgatgtggagacagccacaaacaattacagctatttaaagccaataagataactgctttaattaaatactacacagtgcaatatgagcacagcaaagcacctgggtccaggaaggcctcacagagcaatggcgattaaacctattccctctctctattcaggcagtgaagatggaattactagttggaggagtcagataacactgttgattcacattcatcttacagtaaactaaaaccattacatcccacgttgcacagaagggcgatgatacttaaagctcttaacagctctctctgagcctacaaaatactgtctcaagagaccagcaaagtgctaaggtcaaataactctcacttgcaagtgtttcatctgaattgtgcagataatggaacgctcttaaatactacccaggtcagtttttgtgattttgattccatacgcttaaattttcattccatccttcttgaccatttggatttcttgtccatttgtgtgctgatcacatcacaacagcatcaaaacagccctttcaagatgaataacctacttactgaatttatttccagatgatcaagggaaggggaagagagaaagtctctggttctataaaacatttcctgatgggttagaaatgtggctgattgcagaaaacaacaataacaacaataaaaagcacctctgggaacatctgttttgagaagaaaggcccctaaaggtcagtctttttaagtgaacagaagctggtgtctcttagtcctttgatgatgcatactcaacgggaaagttgtaaagataaaataattcaggaaacgaggacatcgcaggacaaattctccttgcctttattgtttctaaacacatcagcaattcatgtggtccagaaacacaagctacagctttccagaacaaagaatcttacagttggaaaaattagtactgactgaatacttccatgtggactcaagagaggtgccagggactagtgtcaggagagacgaagttaagatgcctctcagataactcagatttctatgaagcagctgggttacccgtttccaaaacaccttgcaggccgtcatggaatttcccttcctctacctgcatgccacaggactttgcacaacaaaggtaccatccattttcttgaaaatgggattatcgggccaagcacagtggctcacacctgtaatcccagcactttgggaggccaagtcaggaggatcacttgagcccaggagttcaagaccagcctgggcaagatagggaggcccctgtctctacaaaatgaaaaaagtgagccaggcgtggtggcacatgcctgtagtcccagctactcaggaggctgagcctgggaggtcgaggctgcagtgagccgtgatcgtgccactgcacttcagcctgggtagtcaagcaaaagtctgcctccaaagaaataaagaaaaaggaaaagaaaatgagatttgtcatttatcacacatttactgggcagctctgtagtccaggtatcagcaggcaatggagagaactccagtgttatggatgtgtgaggacacctcctcacatccttacccgtgtgatctgtcttacctgtgagcagataacacagggaactgcctgttgcttggcaaatgctcaataaatgttggtttcccatggggcatatgcaaccccaccaaggggacctgccaaatctcctctataaacattcaaagaaacataaaaggacacatagcaggatatcttccacccacccaagacccacaatcccctaagcttttccaagagatatacagaattcccccagacactgtgtgtgtgtgtgtgtgtgtgtgtgtgtgtccttccagcaatcgcccaggcataatcaagcatgagtatgtgtgtgggtgggtgtgtataaacacttataccctcttcttgttttcctacatctggcagcataccacatatactttcctgcaaattgctttattcttaaacttaagaatatatcctgaaaatcattccttcttagcagatatgacctactattttaaacaatggcggagcaatccactttaagaatatacattcaggccgggcgcggtggctcacgcctgtaatcccagcactttgggaggccgaggcgggcggatcacaaggtcaggagatcgagaccgtcctggctaacacggtgaaaccctgtctctactaaaaatacaaaaaattaaccgggcgtggtggtgggtgcctgtagtcccagctacttgggaggctgaggcaggagaatggcatgaacccaggaggcagagcttgcagtgagctgagatcgcgccactgcactccagcctgggcgacagagcaagactctgtctcaaaaaaaaaaaagaatatacattcaatcaattcgctactttttgttttttggagttttgtttgttcattttttgaggcagagtcttgctcttgtcaccgaggctggagtgcagtggtgcagtctcggctcactgcagcctccgcctcccagattcaagctattctcctacgtcggcttcccgagtaactgggattacatacaggtgtgggccacaacacccagctaatttttgtattttttggtagagacacagtttctaccatgttggtcaggctggtctcaaactcctggcctcaagtgatctgcctacctcggcttccaaagtgctgattataggcatgagccaatgcgcccagcctaaatcaattccttattgacatacattaagttgcttccacagtctttctattactagcaatgctgcaatgagtatatgttacatgcatcttcacacacatttataactataggaaacatagaatttataagagaaaatccttgaagcagaattgcaggatcagagggtatgtgcactcagaatggtgccaaatggccctccaaagaagttgtactaattttcactctcatcagtagtagaatgagtatgcctgtttctccaaccacagtcacaaaaggttgttttgtttttaaatacaaaagaagaaaggcagagctcactcttgtcccattgtctcttcttgcccctgtgatatcattaatgacatgactacttcttaaaaattccacacctggatgcaaaacccagagatcaaagtttaaaaaaggccaggcgcagtggctcatgcctgtaatcctagcactttgggaggccaaggcaggaggatcacttgagtccaggaattcaagaccagcctctataaaaaataaattttactttatttttaaatttttaattaattatttttagatagggcctcactccatggcccaggctggagtgcagaggaccaattctggctcactgccacctgggttcaaacaatcctcccacctcagcctcccaggtagctgggaatacaggtgcataccaccacacccagctaatttatattttttttgtagaaacagggtttcgccatgttgcccaggctggtcttaaactcctgagctcaagtgatcctcccaccttggcttctcaaaatgctgggattgcaggcataagccaccaagcacagacaaaaataaatttttttaaaaattatccatgagtgttttttaaaaaattagtgcagtggcccataatcacttcactgcactcaagcctgggcaacagagcgaggccctacctcaaaaataaaaaaacaacaacaaacagagtttaaaataaaatgaatgccaaaggcagtggtgttctgaaggtggctatactgactcaagagtcctaaccatgttcatttcttccaaactccgtgttcagtggcatcatgttggtagcttgaaactggtcatggtggaagtatttacaccataggaatcagcaaatgctacaaattagggcttcttttcttttctttcttctttttcttttctttggttttgttttgttttgttttgtttttttgtttttttgttttttttttgagatggagtcttgctctgtcgcccaggctggagtgcagtggcgcgatctcggctcactgcaaactccacctcccaggttcacgccattctcctgcttcagcctcccgagtagctgggactacaggcgcctgccaccatgcccggctaattttttgtatttttagtagagacggggtttcaccctgttagccaggatggtctcgatctcctgacctcatgatccgcctgcctcagcctcccaaagtgctgggattacaggcgtgagccaccgtgcccggctttctttcctttttaaatcactgtaaacatttaccagcacaccaatgtagactacagtgaaaactgagggtataccaccctcctttgaatattttgccctcaatggtgacctggtcacaaattcttggaacctaaggattggaagatgtctgaaaggacatctaatccttacgtcttctaatactgcctctcccttagtccctctatgtagatgtaagtagtgccattgatacttcttcaccattatttcatatacccatctctttatcgcttagtgcctactcttggtgatttcccatagtataatacttgcaaacacagacccaaggctacccaagacagcctggagtcaaatcccagatccatcacttaccagctatgtgaccatgagctagtggcttaaactgctatttagtttatttgtctataaaattcagatgatcataatgcctcctcataattttgttctaaggagtaaatgaattaatgcaaataaagtacacagaacaatggcatgtactatgcacttaacaaattttaactgtcatcgtctctcagctcagctcattaattctctctttagctatgtctaatctgtcatttaactcttttgttggatttcaattttaatgattatttttcctttcaattcagctgctcttcaagtcaacctattctttttccatctttctttacattttttatatcatccttagttcttaatcattttatttcttttttcttgtgaacctaaactaagacatcttaatcattttaaatataccatttttatagtctcttataaatggttttattatttccaacttggaatggtttcctgaatatagtttttcattgtgaactcgtcttcagaggtcattctcactgtgggagtgctgttaggtataggttgttgaaatatgcctatggaatgactttgcgttcgcagtagaggtttccatggtactagaccagttcttacgttaatttttcaggttgaagggtctcatacctcataagtaataaaaaatacagattccacaaccatatatagtacaatcccatgtgtttaagttcttgctggtaactttttttccagtcaagtcaagcttcctctctatttctccaagtattgaagtttttctagccccttttcatgaaaaagtcagaccttcaaggctccagagcactcaattccaccttgagtccaggcctccttcctagagccaccgtgccattaaaactttggccctcaggctctatagcttctgtgcaaaagccccaggagtagtcatggcttcagctcacatgccaccatttagcttaaatttgtcctccttttttttttttttttgaggtggattcttgctctgtcgcccaggctagagtgcagtggcttaatctctgctcactgcaactttcccctcccaggttcaggcaattctcctgcctcagcctcctgagtagctggaattacaggcatgcgccaccacacccggctgatttttgtattttcagtagagacaggccttcgccatgttggccaggctggtctggaactcctgacctcaagggatctgcctgccttggcctcccaaagtgctaggattacaggcgtgagccaccgcggccggcctatcctcatttttgacatttgcaggtttccctttcttcagcgctcccctagataaaattcttatatttccatcaattctgtattcataccaggaaggactcacacaagtcagcttagtccaccatgctgccagaagtattccaggtcactaaatttaatataaccacttatccacacttgagttctgcccacattaaaattgtatctactcaagggttagcttctgaagccagcatgttgtgtgaaaattgaaagaagccaaaattccccttgaaaaatcccacaataaggtctcaggttggagacaaacaaaccatctttcatgaagtccaacacagccagtctttccttcagcactggatttggtttcttagggttgggcaccatatgtaataactggcttagatttaggggccatgttgtgtgataattaaaatccataaatatgagaaacatatttggtggcacaagatgctcacatcctaaaaagccatgagaacaaatgaccaacagacggaatagcagatccatgtctgccattcacacccactccaagagagacgcccattgggtggaatgacaggatcacctacactatttaaagtggtgttttatccttttgcttttgttgagcaagtatatttggatacggccaaggtggaagcatgaatctatgttgacagacgtcagaatagtgcttatctctggggcaacactaagtgcaaagggcatgagggacctttctagaaatattgtatatcctgatttgggtggtgattagatgggtgtaacatatcaaaatttcaccaagctgtacgattaagatttgtgcattttacagcatgtaagatagctcgattaaaataaaagttaaaagcacgcctacgtagaaatggctgtacagtattttgccaaaggtccccatcctatggttaagcctcaccagtgaggatagttgggagtctaggaaaccgggggaaaaaagaagtagaaaagggaagtgcactgtcacagacagagggcacccaggctccaagagtcaatggttttccgtgaaggcccttatagggttgacaagactacattagttaagagcactgactttcttttttttttttttttttgagacggagtcttgctctgtcactcaggctggagtgcagcggcgcaatctcagctcactgcaacctccgcctcctgggttcaagtgagtattttgtatttttagtatttttagtaaattttgtatttttagtagagacgggatttcaccatgttggccaggctggtcttgaactcctgacctcaagtgatccacccacctcagcctcccaaagtgttgggattacaggtgtgagccactgcgcccagcctatagttcttatttaaactaataatttgacctaaaaaccttgtaggttcatggaatgaatgaatattcatagagtgaatgaaggggtgtatatgtattctgatttcaacagaggtaggaggttcttatttctatgcaactgaaatccatcttgtagccatcaccatccactttaatttttcctcataggaagtgtggttaagagtgctggctctggagccagatgaccatggtcaaattccagctctgttacttaccaactgggtaaccttgaatgagttaatcaaattccaggcctcagtttcttctcctgtaaaagagttatagcaaggattaagcaagttacaacagttctcagtacacagaaagcccccggtaaatcctagctattgtttttttcccatagtagaggtacagtttgggaataacaactccaaatagcatttgtttgtttgattgtttgtttgtttttaagacatagtcttgctctgtcgcctaggctggagtgcagtggcacgatctcggctcactgcaacctctgcctcccaggttcaagcaagcatgcctggctaatattttttatttttagtagagacagggtttcatcatgttggccaggctggtcttgaactcctgacctcaagtgatccaccagccttgacctcccaaagtgctgaattacaggcatgaaccaccgcacccagccccagatagcatttgtacagtccattatatcactgaattgttttgcaaacagttttctcatttaatgctcaaaatagtctggtatattacaaataaataaacattcagagaagttgaataatttgctgaaggttgcacagcaagtaaagaacaaagacctaaaccaaactcctatgactgaaggacagtttggctggactgtgttgtccttaggagcatatatggtggggccagcgctatccatggagattcagtataaaggatattgggacccttggctgcagcagcaagtcttggtcccagcaaaatgctcagttcaacttgagtttaaaacggtcttagtcattctgtcccctgaatcacttcctgtttcaggtttctactttgcagagaaagaaacacaaacaggtacattacgccagccttgtcaccctccaaaatctcctacagcaacaaaagctgatgaattaaagagaagtttcataaaaccacagttaacatcccatttaatgcattagccagcagttagtgtgaagatctgagcaaagtcggcagtgtctagacactcttattattgaatggaagagaaacaggatgactttttctctggcctttattctgattaaatctttagctgccttagtgttttctctttgcttttcattgggtgctgaaactaccggaagctacttaaccagccttgttttattcacaaaaggtttaggggccatgtctaattgtccagagagaaccctatctgctgataatttcagccacttcggctgcttttgcagctttttgtttgccagtgtaggttttctttctgtcgttcttcttgctatggcatgagtgtggtttcacattcccttttaaataataatcaccgaactgctcagtggccaagaagaggatttaagaaccatctaggccaggcacggtggctcacccgtaatcctaacattttaggaggctgaggtgggaggatcacttgagcccagtaatttagggagctctcgtctctacaaacaatttaaaaattagctgagcgtggtggcacatgcctgtagtcccagctacttggcaggctgagacaggaggatcacttgagcccaggaggtcgaggctgcagtgacccatgatgtgcactgtgctccagcctgggtgacagagcaacccgtctccaaagaaaataaaaaaaagaaccatctaagcatactgcatactcacaaactatgtcctcttatgtacacacatagactccacacataccacacattcattccatgtacacacaccacacatacaccatacacacatcccatgcacacaccccacacacatcccaggaacataccccacgcacatgcacaccacacacacacaccccacatcactcacacacccagcacacccagggcatagagtgtggctctgatagaagtaacatgggcctctaaacaagtgtggcttcttttcatttccaagctataggcagaaagcctggactacagctctagaaaccagatctcgcctcctcttcagcctcatagcatgtgtctcatcccttctcagtctttcggagcatctgacttgggcaagtcacttaacttctgttataaagtgaggacactcattcactcaatagctactgatcacctattgtgtgccaagcattgtggccatggaaataattccatgaattaaaccgtcccagccacccaggagctctccaagattaggggagcaattacaggcagatgaacgctctgaaggaaaggggatgaggcaatctctgaaaagggtatttaattaactcagcaggggatggaaagtgatggataatcgaagaaagacttccccaaggaggtaatactgaagctgagaagtaaaagttaagttagaattggccagaggcaggaagggatccaggcagagctctccgcacaggcaaaggctggcaagttagactgctggtccattcagttaagcacaggaggtggaagagggatgggcctcggtatgtcaggggtgggcttgccagggttacccgcctgggccaggtgcccccctgaggtccctcccagccctcaaggcagattctatcatcttctgagagcccaggtcctctccttccctgacagccttttcaccagcatgctgaagtcggctccagaggacaaggggagtcccaaccacctcacgtggactcctgctccttcctctttcgtctcctctcagcagtgaccagacagtgactcagggaagggagctgtcctctatttgtcatttagttctttaaaaaatactcgcctgtagtcccagctactctaggggctgagaaaggaggatcacttgagccttggagttcaattccagcctgggcaacatagtgagaccctgtctctataaaaataaaaattaaaaaacacccagcgctcttatacccaactagccttctaaccaactccctcctttctcccacccagtccctcacctagctgagaaaggctggatttctctgtgtccttatccgtctcctccaagagactttaagctttaagctacctgagggctcatgctaggttttggtcatcctggtgtcccccacacccggtactatgcctgatgtctagtagatcaaactgattcccctccctgaaaatgagcactgcccagaacccacccacagggcagcctgtctgaggccaaggcaggagacccagaatccagccgacccaacactcctccccacagcactctgtaggagactctgccctgtgaatcccaatttgaaaactgacagctatgttagtctaattccctcattttatcaacaaagaacctcaggcccaaaagaatgatatgacttgcccaaggtctctcagcaaatgtgatataaagtttttttaaaggagcaaaacatcgcttaaatggaagcctatctatcacccctaccagaaacgttgcttattttaagaagaaaacccttaatgtttgcaagtcgaatggaagctttcctttctctgaccaattttgccatactttcatgactcctgggatgctctaggcagcactaaaagttcccactgaagcaaatctatttacaaaggtgaccaggaattgttttagggattggatatatttttgattatggatcatttttaaagttaattatctattatgtgatctaaggctataataattttttaaacaattgagcctcccaaaccacttagatgcttcctggtttttaaaaatgttttgctattttaaaatgttttgctattaaacaactttactagaagtaaaaaaaaaaaaaaatcacagatttttttttttttaaacttcaaacagggtctcactttgttgcccaggctggagtgcagtggctcaaacatggcttactgtagcctcaacctcctgggctcaaagtgctcctcctgcctcagtcccccaagtagctgtgaccacaggcacgtgccaccacacccagataatttttttttttttttgagacggaatctcgttctgtcacccaggctgcagtggtgcgatcttggctcactgcaacctctgcctcccgggttcaagagattcttctgcctcaggctcccgagtagcttgggactacaggcacctgccagcacgcccagctaatttttgtgtttctagtagaaacagggtttcaccatactggccaggctggtctcgaacgcctgacctcagaatccgcccacctcagcctcccaaagtgctgggattacaggcgtgagccactgcgcctgacctaattttttttatttcttgtagagacagggtgtcaccatattgcccaggctggtctcgaactcgtaacctcaagcgatcctcccgcctcggcctcccaaagtgctgggattacaggcgtgagccactgtgcccgaaacagatgatttttaaggaagacatttctacccataatccctccaccaaaagaaagaattccttacaattctgtgtcctcctaaactgttttatccacagttctgtactctggacatatgtatgtatttcattaaaacacattacctttagtataaaagattgttaaatagtttccttttttcttaaaaaataaaaaagacaaaaacttttattatgcaagtcactggcaccatgtttctgataaacgccacggagcaaaacccaggctacaagttaagagcacctggaaattctgggtttgagacttttaaagcaacattttctagcctgcttcattccataattattctgacactttccacatcccacttaataggaaacagacgaaggaaaacaggtgttttgcttattctacttggcatagcatgctctactgcagaagtttgcagcagttgcttattgctgtatttttcctgcaagtgaaatgacatctctggtttgtccagagtttaaaaatactgcagccgggtccccactctgcataattaaacagactctctggggaagcaccccagcaccatattgctccaaagctccccaggtgattttcatgtgcagctgggactgacaagcaccaggctaagataactcattagtcaaaggaagcccatgggaaatcttatctggaaatgaagaactcttgtaattaaataaaatagcagatgtaaaagtccctaacagtgcctgttacccagaagacaataaatgttaattaaacaaaaaaaaaatttaaataattactccttcccctcagtggattcatcttgttattttattggcttgtttatcacttgtttttttttctttaccatgattcattctatccctgttaataaaattataaacttatgcctataatcctgttcaattacaagagctctgtaatatttctaacaacgctttattgctttatttaataaaactttcccccagtacagtggcttatagcaaatatgcaataaacatctgctatttataataataatggatattcagaattactttaattcagaattcatgaccgtttttctaaactagactgaaatttatttcacattattaggaccagttagcaacaatgtaaaaaattattacggcaatgtttaacaaacttaagaaaacagacctttaagcaaaccaattcttttttataatttcctgggaaaaaactaaatgcagtcattacacaggtgaacttatctcccattcaaggaggccttgctcagctcttcccatagttacctggagaggctaatactgcaattagttataagcggtttttccttccaatttctccctacggctgcctctctgagcgtgaatttggaaggtgattcttaatgtttacattacccctcagttctgagaagccaaacatttgtttgaaaaaaagaaatagaatttctgaatcagaagaaagagtttttgtgtgtgtgtttatgtgttgttgtttttttttgttttttggggtttttttttaattgagacaaagagtctggctctgttgcccaggctggagtgcaatggcgcaatctctgcttactgtaacctccgcctcctgggttcaagtgatcctcctgcctcagcctcccaagtagctgggattacaggcatgtgccaccacgcccaactaatttttctatttttagtggagacggggtttcaccatgttggccaggctggtctggaacacctgacctcaagtgatccacccacctcggcctcccaaagtgctaggattacaggcgtgagccaccgtgcccagccagaacaaagaggtttcatgaaggccatttccaaatgtcttgccttgctggcacaaacttccccagtcatcttttcttgtgttgtgccagacagagaaggcatctaacaggtatgtgggaagctgggccatgttcagctcaagattcacactcgttcacagtagacctctgtatggctcacacatgaactctgctatgcttcagttcctaaggccatccagctcccaaagtctgccatgtcatgttttaaataaactggactcgacacccagccaaaaataataatgatgtgcacgtctctgtatgtaaatgtcaataataaggtacaaaatgatcacacatgggccaattcccatcctatactatttggtattatcacctaatatttgtcctcactctttttttttttgagacggggtctcgctctgtcacccaggctggagtgcagtggagcgatctcggctcactgcaaactccacctcccaggttcacgccattctcctgcctcagcctcccaagtagccgggactacaggcgcccgccaccacgcccggctaatttttttgtatttttagtagagatggggtttcaccgtgttagccaggatggtctcgatctcctgacctcgtgatctgcccgccttggcctcccaaagtgctgggattacaggcgtgagccactgctcccgtcctgtcctcactctttcaatgagatcataagcaccttgagggtggacatcttgtattagcagtagtagaagtattaattttattgatttatttatttttaatagaatcttgctctgtcacctaggctggagtgcagtggcaccaccatatctcactgtggcctcgaactccggggctcaacagatcctcctgccttaagctcccgagtagctggggtactactcagttgtacaggcgtgtgccaccatgcctaattttttttttatttcatgtagagacgaggtcttgctatgtgcccaggtcaatcttgcactcctggccttaacaatcctcccatctaggcttcccaaagccacagtgggccaccgtgcccagtctaattgtagtttcgatcctcttaattgaattgtctatagtgtgttatatagctaatcagattacctgaataataaaacttctctttcttatgttttcatttaatattcgatcagccaagcactaaatgactattgtgagatggttgtggggcaggcttcacacaagtgattccaatttgtcttggttgatttgaacttgtaggaaaaactgcaatgtctgaaacctccaccgtaacagatttagagagaatccctggagactcaagcctcgcgctgtgggcaccatctccccaggcatgtgccaggatgatacagaacaaaagatgcacctcaaaaatgaatacatttggaggaatcctcccctgtgctagagttttctaaagtatccctcaatccattcagaacatgtccttttatattagccaggttctctaccactccatcaatgtgtgttattattattatttcccaagtatgcagttcagaaaagatgctaatacactggggttggggggtgtcctttgaaacacattcccaggtgtttaatttcctattcataactagtgctaaccagctaagtgcgtgtacacacacacacacgtgcatgcacacgaacacacacacctttttaaaaatatatcaatgttggccgggtgcggtggctcacgtctgtaatcccagcactttgggaggccaaggcgggcagatcacttgaggccaggaattcgggaccagcctggccaacatagtgaaacctccatctcgtactaaaaataccaaaaaaattagctgggcgtagtggtgtgtgcctgtaatcccagctactcaggaggctgaggcaacagaatcacttgaacctgggaggcagaggctgaagtgagcggagatcgtgacactgcactccagcctaggtgacagagcaagactctgtctcaaaataaataaataaattaattaattaattaaataaataatatatcaatgttttacaaccctaataccaggaaaacacaaagtacttctggttttcagtgcatgtttaccaccaagatgcaaatcccatacacattttggggtgccttggaaataacataactgattcttgggtccactacaagtttacaaacattctctggcttggattttctgtcaatagtagcataacatttttctatgctaacatatgaaggaataaagcctattagaggttcttttattcacaaactgtcttctccgagactataaccttttaggttgaaccactattagctggaaacttcctctggaaggataagtgagaacagcgcccacagtgcaccttttgcccagaactcgggcccaagatctggggagatattgctataatactgggtcgttctctttcaaagatgataaacagcaggagggtctattaattatcatttcccagctggccatggtggctcaagcctgtaatcccagcacttcgggaggccatggcaagcagatcacctgaagtcaggagtttgaaaccagcctggccaacatggtgaaacccagtctctactaataatacaaaaaaaaaattggcctggcatggtggcaggcacctataatcccagctatttgggaggctgaggcagaagaattgcttgaagccaggaggcggagggtgcaatgagccgagatcacgccattgcactccaacctggatgacaagagcaagactccacctcaaaaaataaaataaaataaaataattatcatttccctttaaactcataaacccttaaacatgaaccatcttccagaaccaattctgatgcatgataaaaataaaaacacagtttctacattttgcctaccacactcctggcataggctgatcacagcttaagacacacatcttcatttttccacagtatcatgatctattgcttacatagttaaaattgtttttaatgggccagagaaggaggttgcagtgagccaagattgcaccactgcactccagcccgggcaacagagcaagactccatctcaaaaaaaaaaaaaaaaaaagaaaagaaaaaagaaaaaaagctgtagtacttgcagctctatgtccaagtgacaaatctgccttccagaaatctgatttttgcggtgggggaggacaactacatagcgtggtgcttaacatgttgataaatgttcaaaagaagttttttgatgctttaggccaatcatctgtttaaaccaataacattaattattactgtgtattttaatacgcagtcttgtttttcaagaagtccagttcagcacaccattgatttaataaacaatatgcgctgggcgtggtggctcacgcctgtaatcccaggtactcgggaggctgaggcaggagaatcacttgaacctgggaggcggaggttgcagtgagccaagattgtgccactgcactccagcctgggccacggagtgagactctgtctcaagaaaaagaaaaagaaaaaaaaaaccatactatgaggtcaggcacagtggctcacgcctgtaaccccagcactttgggaggccaaggcaaaagaatcggttgagctcaggaggtcaagacgaggctgggcaacatagtgaaatcccatctccaccaaaaatacaaaaaaattagctggtcgtggtggtgcacacctgtggttccagctactcgggaggctgaggtgggaggatcgcttcagcctgaggggtggaggctgcagtgagcagaggtggcatcactgcactccagcctgtgtaacagagtgagacactatctcaaaaaaaaaaacacacacactcacaagacaaacaacaaaacaacataatatgaagatgggaagaagacagaggaggaaggaaacgaactatggtgtactgaaaagccagatcccaataccatctcagttaaactgagagacagagttagccccccattccccaccttttttttcaagacaaggtctggctctgtcgctcaggctggagtgcagtggtgcaatctcggctcactgcaacctccacctcctgggctcaggccatcctcccacctcagccttcagaatggctggaactacaggcacatgccaccacgccttgctaatttttgtttgttggttggttggttggtaaagatggggtttcgccatgtcggccaggctggtattgaactcctggactcaaaagatctgccaacctcagccgcccgaagcgctgtgattacaggtgtgagccactgtgcctggctccagccccacccttttttaagtggagacatggacaggagctcactaatagatgagcaagataaaaatgatgtttctgaagcaatggagaactgattatcaaatacttccccagtgtaaggatgtatcacttttaaaggtatgtcactatttacttgaaaatgtgacatttgcagagatagagaatattatttctgggtatctggtccaactccctgattttataggtgagggaatctaaagtctgcaagaaaagaacacgcctggggcctgggagtgggatcacagcagagcaggaccaggaccaagcttcctgactgagcttcctcccatttccaaagcccttcacctggagaactgcttcccgggcttcaggtttcagttcagggagcctgctgtccagacaggtgcccccgctggtccacccgaccactgtccccctctctcagagcactcctcaagctataggtgaaggacaccatcatctattcatctagcttccccgctggactgagagtaactcgagtgggcattcctctttgtgtcctggtactgagtgcagtaatgacatcacatggatactgtgtgtagtgaacaggggatcaacttgtccccattggccagggaatttcctagctttagcaatgcaagtcccaagtcctggaaaacccctcaaccaagatggctggtcactggtagcgacattaacaggatcagacagcctggtcacactttccccttctctaactgtcctccaacacccagcccaggccccagagccctgtctgtgccatgcagtccctccagctcagccctgtccaatagaaccttctgcctcgatgaagatgatctctgtctgaactatccaataccttagcttgggccacatgtggttactgagcacttgaactctggctactgtgactgaggaactgaatttttaattttatttaattttaactaaccgaaacataaatagccccatgcggctagtggctactctgttggacaattcgattctggttttccatttatggaattagtgtgccatcactgcacacagggatgaactttaaagccagacagaccttgatccaagtcctgactcatttaccaatacagcacttcttagggaatcttgttgcttcatctgtaatcctcacaaacttactttgcaacaatgtatggaaagtgaaatgactggccaatagcagaacgtcaagaaacaggatttctctagaagcaactaaaccaaatatatgtccaaatgcgagaaaaatctgattctgaaccaaaaaagcaaacgcatgagcatcatttccagcagatctctaaaacccttgcctgttttaaattctcattctaaattgtcatggctgcccagctgggctcaccacctctttctgtccccaggcctgcagctggctgtcaccaagccactacagaaggtactgcagccaacacagtctaggtacaaacatacatgtccagctctccaaaatgtatacactaaatatgtgcaatttttttcatataccaattataccttagtagagctgttaaaaaaaaaaaaaaaaacacccttggaagtggctcatgcctgtaatcccagcatttggggaggcagaggagagaggattgtttgagcccaggcgctcaagaccagcctgggcaacactgcaagacgctctctctattaaaaaacatataaataaggccgggcgcagtggctcacgcctgtaatgccagcactttgggaggccgaggcgggcagatcacgaggtcaggagatcgagaccatcctggctaacacggtgaaaccccgtctctactaaaaatacaaaaaattagcgaggcgtggtggcgggcgcctgtagtcccagctactcgggaggctgaggcaggggaatggcgagaacccaggaggcggagcttgcagtgagccaagactgtgccactgcactccagccagggcgacagagcaagactccatctcaacaaaaaagaaaaataaatatatatatatgtataaaaaataaacctgttaaatctgctacattaacaacaaaaaaaagtttttaaataagaagacaccattgggcagcaggcactgggtgggagttactgtgccaggtcaccctgagtgtggccccacacagccccaccggcaggaagggatccagggcagggagggatccaggccagtcccagagcagggaccaggcagcgctcacgtgcgctctgcaccagccacagggatgcggggacgctggggacgcggggatgcggggacaccggggaccgcccgggagcacgtcctgcgcatcgccgggctccgcgaggcctgcagaggacgcagccctctccctcccgctgggtgcggaaccgggtgcaagaggccgaagcgctgccccataaagccgatcttcgccggggccccgcccaggccctaacgaatacatcccattggcaggaaccggcagcaggtcctaggagaagccagcctctgattggaatcaaccgggagctttttaaaaatattgttccccggaatcggagatcagggtttacagacagctcccaggtgatggtgctgcacagctggggcctccgtatttttcctctgaatgcctgaggaggtgatcctgctgagccgccaaggcggggaacaccgcccaccagcagggagaagcactatttagggctgtggcaagaagtcctatccttaacagtcccctgcctctctctggctgcagggacaacagtcagagggctgcaggggcctgaagccagacacgggacacaagctgcttccctctccttgcagatggctgagcactttccagttgcccaggacctccccatccagtgtctcccaggcagggctggcagggaggccctcttccccacccactgagcatccaagtgcgggaggcctaatccatgcacctggcacttaggaagcccacagtcactgctgttactgtggttgctaccctcatctcactgggaaagaagccggctcagagagatgggatgagtcacccaaggccacatgatactgggggcagggctggcacaggaacactgggctctagggctcattctcctccctgtaccccaggatgcggccactgccctgccctcccccaacaccttttttcctccctcttacagaaaacaggcaggctctaccagtcaggataacacttcattcattgcacacgctagggctttaattcatgggaccccacctgtcctcctcaaaatagtcctgggtcctctaggaatgccctccaaccaccaagtggtgggggttttttttgtttttgtttttgtttttttgagacagtttcgctcttgttgcccaggctggagtgcaatggcgcgatttcagctcactgcaacctccacctcccaggttcaagcaattctcctgcctcagcctcccgagtagctgggattacaggcatgtaccaccacgccaggctaattttgtatttttagtagagatgggatttctccatgttgaggctggtctcgaactcctgacctcaggtgatcgcctgcctcggcctcccaaagtgctgggattacaggcgtgagccaccacgccccacccaagtagtggtttttagtacagctttgaagcctgacacaccagggttgccactcagtagctgggtgatctgggacaagtttcttaacctctctgggctcagtttcctcttctgtaaagtgggactgataatatttaccagtaagggttgtggtgaggattattaggtgagatcatccagcggatgggatgggcaccacagcggctggcagcaagtactaacaggcagtaggtgccactatccagaaggccggtctttctcacggcctctccacgctccatcctggcccgggaaagctccacactgctcaccctcttgccttactcacccccttgaaattccccaggctccatgagccggtgacccactgcctctcgcttgcccaaattcctcttgggtgcctggtccaccctggagacaatggtgacccaccatgtggctggaggtaccacatcctcccccaccccccagaaatagtaaatgagaagtaacctttttctattccccattccagacttccttaattaaaatcaaatatttgcacactctccaaagcctataaacctgattgctctcagaaaaaaaaaatgcttcagagcaaatagagtgagtgtggcacaggttgtctggcaggacctcagggtacagggcagcaggtcctgaacaaccacaccagcccagagcagtcgccctccacttttctcagtccacctccacaacaaatcaatgcaacattcactttgcaaaaggcccactgaaaagcccctgagggtgagcaggtgttgggaagggatggaaatgaggaacagtctaccccagccctaccctgaacactttcaaaccagccacttcccaccggcatggctgcccagctgttaaaatactgagtccttccacacaggctgggaagtagctgctgccccaggagtcctcaccctaagtgtccctcccccagcactcccagacctcccccaggatgcagcaaggaaagaattagtgtcagggcaccagtagaggcttccagaaagtactgcgatctgtgcccgaggttaaatattctggccatcacccctgagcactggtaaggggcatgaagatgcaaacgaaattctgggggattcagaagagggacaaggtttcaataaatgattgctaaaggaagagagaggggaagcaggtgaagtggagacagaagggaaagtgattcaagtcgtagttcagtggccccgaggacaggccccagaactgcccacacctccctcctctaggccactcactctatcccagttcaggtcaccattgcagaagtctccctagccaggtgctacagtttaaacatttgtccccctcaaaattcatgttgaaacttaatccccaatgtggcagtgttcagaggtgggaccttaagagatggctagatcctgagggctctgccctcgtgaatggattcatccattcatggattaataggttaatggattaatgggttatcttgggattgggactggtggctttagaagaggaagagagacctgagctagcacgagctctctcagcccctcaccatgtgatgctctgcacagcctcgggaatttgcacagattccccaccagcaagaaggccctcaccagatgcagcccctcaaccatggacatctcagcctccagaactgtaagaaatagcttccttttctttataagttacgcagtttcaggtattctgttgtaagcaacagaaaacggacaagacaccaggcaaaagcaaatccagcactgcatgccagcctccaagccccttctggtaatggcactgtcttcctctggggcatcccctaaccctcccctaatgctccaggggtggcacattacctagaggaggacagtcaaagcacggaacctccagaaccaatagacggctcaaatgcagccatatgcccctaactagacagtaagagacttctctcacactttggctgaagccactaggaaaggggtaccttccccctaccctacagcgttgctaacatgagtggataaaaacctgaatccaagctgatggcctcttgccatcttgaaaggagagactgcttgagaaacaagaaagaaaagcagggccacgacacaggagacaaaacctggcccacacagctggggcccctggatcagccatgcctaaccaggtagtgacttgacacaataaatgatcttttctagatttaagctaccttgagtttggttactgtcacttgcaacataacgctgacacaatgttctgcgggttaatgagaggctgctggttgctactaggtcccacttcctaccctggctaccatttcgggtctgactgtggcttgttgatggcacctgggaggctgagctaagtccccaagccctccattcatgcaaacacaccatccctctctcattgtgggccccggactacattctctcgcctgccacctcccaccttttcttttctttttcttgtctttttttttttctttttttttttttttttatgagactgagtctcgctccgtcgcccaggctggagggcagtggcacgatcctggctcactgcaacctccacctcctaggttcaagcgattctcctgcctcagcctcctaagtagctgggattccacaggcaggcgccacctcgcccagttaatttttgtattttgagaagagatggggtttcaccatgttggccaggctggtctcaaactcctggcctcaagtgatccacctgcctcggcttcccaaagtgctgggattacagtcgtgagccatcgcgcccggccccaccgtttctagtacacaaatcctccgctggctcccacggcctacagactgggacgcaagtccctttaatacaccttacaaagccaccatcagctgaccctgatgtcttcaatgtaaagtttttgtatcggttggaaccctgcgagcacgccaacagacaacacgaggcggtgtggagcaacatgctgttttaatgagcgcctggatgcaggcgggctgaggcctaaaatggcgtcagccccaagtgaggacggaacaaaggtttcatagtctcctgtaacaggaagtctcctagtcgtacgaaactgctacgtgatacccggatggcctctttctcgatcttcaggggtacgtatcttccggccagggcaggtgtcttccggccggctctcttcctgattccgctatcttgcttcggcacgctgctgacgcaagtagccttgcgccctgggactgggcctgagaagggaggagtgatgcatctccttaagctttcaggccccggggagaatcttacactcaggaaccctctaattcagccacgtggacctgtgaatgttctttgactatgctgagatccttcccacctccaggcatttgcacgtgtcacctgacaggaacagtgtttccgaatgtttaggagtcttagcaagcccaccttataccataagctctctgaggatgagggtaactcctcatgttctataacccacatccagtccactgaggtcaaagcctctgctccctgtgggcgttggataaatattgaaaggacctcataaacatagcttcttcccctccgtgattaccaaggcccataatcccccaagctgtctaacacccacactgggacagaaagaggctgagttcaatatgtccttgttatgtaaattatggcgggtggggtttttttttctccttgttttaattgaaaaacgaccagatgtgtacatttcagcaagagccctaaggaaaaaatctacaaagaaaacttctctcaacgctgcacatgaactgagagcgcttatcattgcaacgttgggagagttcatttcaaaatagaccctggagatcttctagtacaaccttcccattttacagaaatggaaactgaaatttcaagaagcgaaatcaccgtccagcatcacacagctaggaggctgacctgccaggacaaataccaggttctgtcttttccccccaacatttattaataactgaatcttcattttcacttttctttattacaacactcattacgcactcaagaatggaagccacagagaagcatatgtgttttcggctctttgcaccacctctcagtgggtctctggaaaatggggtctctgtgtttaccagcaggacgactggagccttccaggcgttagactttctgtggtctctcaccctctctcctaccggtaaatatggccaacaccagcagcacagatggcagctgcccactgagcaatgaaaggcggtctctacttcccaaagcggaccgaggctgttctcaagtttccatctcactgattattttgaaggaactcaaattaagttactcctcagacaatctctgattttggcaagcacctaaatcaacacgtaaggggcactctgagtcgttccctctgcagggaccagggtgtaggtagcaggtgcatggccagagggggtcctcatgaaggcagcagagcagcacaaccagaagtcactcccaccccagcctcaggacgtgttcaggacctcgcaagcctgatgccctttcttttttttttttttttaattatactttaagttttagggtacatgtgcacaacgtgcaggtttgttacatatgtatacatgtgccatgttggtgtgctgcacccattaactcgtcatttacattaggtatatctcctaatgctatccctcccccctccccccaccccacgacaggccccggtgtgtgatgttccccttcttgtgtccatgtgttctcagtgttcaactcccacctatgagtgagaacatgaggtgtttggtttcttgtccttgcgatagtttgctgagaatgatggtttccagcttcatccatgtccctacaaaggacatgaactcatcatttttatggctgcatagtattccatggtgtatatatgtgccctttcttatttcacatcgttgactttccgaggcagtaagagggccacctctccaacttgtcctcagttttagagcacttccccatctatgaaggcacagttttcttctccatctcttctactaggctgtgctctccctggtgcccagcacagtgtgggcaccaagtaggtgctccataaacacgtgaatatacatatatgtatatactgtatatgcatgttttatacatacaaacatgtttatttgtagcatatagttggcattcaataaacgcttgttttatgtagtcttaacacacacatgcatatgcatgctttatatatctagataaagtatgtttcatctataatacataataggtgttcagtaaatgactggtatatacgtaatatgtataatatttcatgctgctgagcaaatgaataggtaaagaacaatacggtgtgtgtgtgtgtgcatgcatgtgtgtgtgtatgcgtgtgtgtgtgtgtgtgtgtgtgtgtatatattttttttcttccccaagacagggtttcactctgtcaggctagagtgtagtggcaggatcacagctccctgcagcctcaaactcccaggctcaagcgatcctcctgcctcagcctcccaagtagctgggactacaggtatgtgccactacacctagctaatttcctttttgtttttttagagacagcgtctcactatgttgcccaggcttgtcttgaactcatagcctcaagcagtcctcccacctcagcctcccaaggtgctaggattagagttgcaagccactgtgcccaaccaagacatggtttaaaggtacaacaaggccaggcacggtggctcacacctataatcctagcacttttgagggccaaggtgagcggatcacctgagatcaggatttcaagaccagcctggccaacatggcaaaagcccatctctactaaaaagacaaaaaattagccaggtgcagtggcaggcgcctgtaatcccagctactcgggaggctgaggcaggagaaacgcttgagcccaggaggtgagggttgcagtgagccgagatcgcaccactgcactccagcctgggcaacagagcgagactctgtctcagaaaaaaaaaaaaaaaaaaaaaaggtacaacaggcgaggagttgaaatgaaaactccaggagggcaaatactgtgtcttttgttctccattgtatctctaggccctaacacagtgcctgcctggcactaagtatgtgctcaataaatactggctgaatagaatggacatttgaaagtcttctccaaaactcatactgaaacgtaatccccaatgtggctgtattgagaggcagggcttttatgaggtgattggatcatgaggactctgccctcgtgaatggattaatccattcatggattatgggttggtgagttaatggattaatgggttatcatgggaggacaactggtggctgtataagaagaggaagagagacctgagctaccaatgtaagcaagcttagccccctcaccatgtgatgccctgcacagccttaggactctgcagagagtccccaccagcaaaaagactcaccagacgcagcccctccacctgggacttctcagcctccagaactgtaagaaataaatttctggccaggcacggtggctcatgcctgtaatcccagcactttgggaggccgaggcaggcagatcacttgaggccaggagttcgagaccaacctagccaacatggtgaaaccttgtctctaccaaaaaatacaaaaattagctgggtgtggtggcacgcacctttagtcccagctatttgggaggctaaggcaggagaatcgcttgaacctgggaggcggagactgcactgagctgagattgcgccactgcactccagcctgggcaacagcagagtcgcaaaaaaaaaaaaaaaaaaaaaaaaaaaaacaataggaagctattaagggttttaagcagaggtgtggtatgatccgagtaatactttttaggctgagcatggtggttcacgcccgtaatcccagcactttgggaggcctggctgaggcatgcagagtgcttaagccaaggagtttgagaccagcctgggcaacatagcgagactctgtatctacaaataatagaaaaattggataggtgtgatgatgcatgtctatggtcccagctattcggagggctgaggcaggaggattgcttgagctcaggcggtcaaggccctccagcctgggcaacagagtaagaccctgcctcaaaaaataaaaataaaaaataaaacaaaaacattttttaaaaatctgatacaatctgaaaatgaattggaagtggggaaaatgtcccctcaggaccctgcccacttgtcagagcaagaaatgaccctactgccaccccctcttggaacagcgctcacaaagataacagagtttcagccatcattattatgagttcactgtttttcgctgctctttaacgaacactgtgaggcactgtgataaatgctggagaccctgagatgaaggacgcacagaccttgttttccaagagcctaaaatccctaatctccaagatcagccagtctttccagagaagcatttaactcagaccaatacttttggaagagggcagagctgcagagccctgatcacccattgttcgtatctctacctttctttgtcatgtatgtgtttattataccttgcctctttccaagagacagttgagatcgctaacaacaagaaaagaacccgtgagaattacaaacagaagaaaatatgatagtgggaaccatgacaaagcaaatggcctgaacctgtgggctggcgacagctgctgtgactaagcgcaaatttggctccgagcttcctggcagccagggaagaaaggaatacacggcaagaaggaagagcaacctttcctctctggtagcatagtgtttcctggctgcctttaaattctacaaaacaaaggtggggcctactgtggatgggcaaggctggggtcagcagggtaaccgtggttgcaagcaccctctcattcatcttgttcattacagaactcaacatcttccccaccgggcacggtggctcacgcctgtaatcccagcactttgggaggccaaggcgggtggatcacttgaggtcaggagttcgagaccagcctggcaaacatagtgaaacccccgtgcctactgaaaataaaaaaaattagctaggtgtggtgatacgtgcctgtaatcccagctacttgggaggctgaggcaggagaatcacttgaacccaggaggcagaggttgcagagagccgagatcacaccactacactccagcctgggtgacagactaagactttgcctgaaaaaaacaaaaaaagaactctggctgaacacaggggctcacacctgtaatcccagcactttgggaggccaaggcaggcagatcacttgaggtcaggagttcaagaccggactggacaacacagggaaacccagtctctactaaaaatacaaaaattagtcaggtgtggtggcaggcacctgtagtcccagctactcgggaggctgaggcaggagaatcgctggaacccaggaggcggaggttgcagtgagtcaagatcatgccactgcattccagcttgggcgacagagtgaaactctctctcaaaaaaaaaaaaaaaattagccggacgtggtggttcacaccagtagtcccagctacttgtgaggctgaggtgggagaagcacttgaacccaagaagtggaggttgcagtgagctgagaccgcaccactgcactctagcctgggtgacaaaaccagaccctgtctcaaaaaaaaaaaaaggagtccttgtgccaccacagcacctctgcctacctccctcaattctcccaccatctggacaccatcatccagttgtgtgtctctctccacctctggactgtaagctccttaaagtccaggattactgcttggttatatactgaattgtgtcccccaaaattcatacactgaagtcttgacccctaatgtcaaagaacgtaaccttatttggatttaggatctttgcagatgtaatgagttagcatgtgatcatagaggagtagggtggggcctaataaggtgataaccacgtgaagacacacacacacagggagaaggccacgtgaacacgagcagacggtgtcacacctgcaagccaaggtacgccaaagactgccccaaaactccagaagctggggggggtggcatggaacagactctcccacacatcctcaagagggaaccaaccctcccggcaccttcgccttggactgccagtctccagaacagctctcagacagtagatgtctgttgagtccccagtttgtgagatgtgtaaagcagccccgggaagctgatacaggtttctttatctttgtatgcctgtgcttagcacagtggctgccacacagaaggtgggttcacctctatggaactgaaccgcagaagcctgggtgttcaaggcacggcatcaggctggggggccatctacctcccagaatgggaggcaggtgcagagagacacccaagctccccgtttcaccatgtcaccaaggcccacagcaggcacagggtgccttgctacagcctggcggtacacaccagtcagggctatggaacatcgacaacagaaatcagctatgactattttatggaaaagaggattttgatgagaaaatatgagaaactcccagaatcaacaggcaaagtgcagagccatgctcagacaaaggaccacggatactgtgcagggggaaaatgtggccaaggccacgtcacaggacgtctgctgcagacactgccactcctactgggcctcaactctaaacaacctcttcctgcccctgcatctgtgcagtactcagcccagggtcagagcagagggtggcagtggtcatgtggccaagctgaggccacaggctgcgagaaagaatgtgtggtccacctcagcttccatactggcagaagaggctctgcctccctccaagacttacatactgagggttcccccaaccaggaaggtgggtggaatgttgagcaccccaaaatataaaaagtacccatgagacctaccaacccaccaagctgcagaattaagtaaaggtagatccctgagtgccatcacaccatgactgagtcctacagagacctacagaatggactcaggctcccagggtggcggaagtgagggagaggcctctgcatgtctacacagccccagagccaagtgtgaacaaaggaagtgtttcttcatctcttaccacagagaacaagtgtgaagcagaatttcaagcatctgctattgcaaaacatctaaagtagtagcaaaaggtcatttccagaaacatccctcttcccctaccctagaagccattcagcatcagttacattgtgaataacactatctgaagcttgttcattcattcagcaaactgtcctaagacccagatgtgcctggcctcgtgctgggcactggagttacaaagatgaatgagttgccatccctgaccacaagctcagtaagctggaggagaggagaacagagaaggcttcactggggatggcaactgtcatggagggttagaggttagtgatgtgaatttgcattccagatgttttttagcatttgctgggcatcacagatttctaaacacacacacatacacacacacatacttcctcccagtcagttacctccttaatcagccaccagcccgaggaccgtggtccagaggactaggcctggatatgcaaacctaggtccttttaggaagggctgcaggctaccaggtaggctaaagatgtcaacatggtagatggcaatctgcttccctgggtggaagacaagacacagaggctgaccccaacacgccagttggctgtgctcttgggcagaccttagctcttggtcagcagctggtcctcaggaaactgggaaatgaaccctgttttaggtgcccctgctctaccctccacaatcataataccagcgcttaccatttgcactgcacactccagtttgtaagacacttttacaggcatccactccttcattcattcattgaacaccaaggcactttgcttagagctaagaacctaaagagtaattaatcacagccgctagccgattggttgccacttcctatgggaagccctccttaacctctcaggctgggatcaatgtcccccaacccccacctcacaccccacaggccacggcagctcagacttccctacatcacaagctccctgtatcagcactgggtctccttctatctaaacttcctggtttagatgtgaaagggactcatccaccccatccaccactgcatcctctgagcctagtacagtgcctggcacacagtgaagcagaatggatgtcctgaggaagtgccagtgggaagacccaggaggacagaggggccgtggggaaacagaagccaagtgggaaagggcaggggagactcaaggtaagaatctggcattatcattccctactcatttgtggattaggacatttatctcagagagcttgagggacttgcccacaatattactgctagtaaactagctgggtctctgcactcactctcttcataccaatttccaaaccaactctctacatctcagacagctttgagccctccctcccccacagcccgcagaattccatctctcttcctgtgaccaacttactgtttgggatctaatgtattctgtaccctccctccggggtattttttttaagataccctgaagatagaagcctgtgattaaaagaaagaaaaggattcctaacgatggaatggcaggaactcacttattcattaaacaaatatttactgaacacctagagtatgttctattctaagtgcaaatataccagcgtgaacacaggcaaaaatcactgccctctaagataccatcatgaaatggtgttatgaaaacccagtatgcctttgtgaaggaaggaaggaaggagggagggagggagggagggagggagggagggaaggagggagggaaggaaggaaggaaggaaggaaggaggaggaggaggaggagggaggaaaggagggagagggaataccaagtgatctattcaagatgtcacttaagctgacccagggaacatggtctattgggggcgaggagacaccacacaatccttcaccccaagaccactctattatctactgcaggataccctgtcctcattcactgtcctttcaatatccacagtagaagagaaacagacagaatgagcctccttttttggccattgctggcttcctaattaaagtcaaggatttgtgtttattcagggtctataaacacagacccaaaaaagtgtttaagagaaagcagatgaaatgtgggtaaggactagctaataaaatcacgggaaaatgctgtgcgttttcagtcatgaatgtgattaaacaaaacttgcaggaggatgctctgagggccaaggcacataaatgtgtgcagggcctgagcttccaggggaaaatgtaaaccataacttcctgcagaattaattggtccctggtgggagatacgtgctaagttcctctggacagagccagagaatcacgatgcagctaatgtgggttcccctccccctcctgccactaggttgtcacatagcctgtcaagactgcattttaaaatcctgtggatttgcaggttccttggggacagcctttggaggaagaaactctgctcaaattacaagaggcacctaaagaagctcagaaacaggccaggcgcagtggctcacgcctgtaatcacagcactttgggaggccgaggcgggcggatcatgaggtcaagagatcgagaccatcctggccaacatggtgaaaccctgtttctaataaaaatacaaaaattagctgggcgtgatagtgcacgcctgtagtcccagctactcagggggctgaggcaagagaatcgtctgaactcgggaggcagaggttgcagtgagctgagatcgctccactgcactccagcctggtgacacagcgagactctgtctcaaaaaaaaaaaaaaaaaaacaaaaaaaacacctcagaaacggaggctgccccttccagagcactgtcagctcatcgcaggacctcagtgtccacatctggccactgcaccagatactggctaaggtccctcccaataacagcttctcacacactacgtccttccaagtcggtacctgggtacagaggaggaccctgttatgaaatatatgggggtctggtctgaatttgaacatgagtggcaaagatgttgaggaaccctgaggattccacaaggaagtggatgactttgcagagatcaaagagagcaaaggaggggtaacatccagggccagccttaatgaaaccctaatgcacaagtttccacaattaaggacaataatgggacaggaaccagtggggcccagaaaacaatcaatgcctttgattaagcactgctgacgaaatttcccattggtgctttaatatggctccccgggggggttgttggctttgcaatgtcttaaggaaactcatctcttttttttttttttagatgaattcttgctctgtcgtccagggtggagtgcagtggcatgatctcagctcactgcaacctctgcctcccagcttcaagtaattctcgtgcctcagcctcccaagtagctgggattacaggcatgtgccaccccacccggctaatttttggatttttagtagagacggggtttcaccatgttggccaaggtggtctcgaactcctgacctcaagtgaaatatataaacccctttctgacttttttcttctccttcttctttttttgaaaattcaagacatggtgctcgatcaatgctaagtagaacagagagccaggaagctcatctttaattcagcgccgacaatcctcagctcagctcaaacttggcaaaacgctttcttccctcgcatctattcatagccgtctgttcctagagttaacgctcaattattcaccctaacagaggaattgtcccatgctctgagaataacgtggggggggtgggacgcaggaggggcagaggagcagggacagagtagaagagaccccagctgccgccaagtaggcagccacactcctctgagagagcagcaaggtgacaacaccctccaggcatggccagtggggaggagccgaccttagtcaccagggcctgcaacacaccaaacatgctgaactgcatccaccaggcccgtctcgggatccctgtccacagggaagggaagggaggctcagacaagtgacatgaccccccaggaacacagagtgagcaaatggcagggctagtgacacgatgcagaggcaaggcccacgtgcgccacgcacccaaggaccagatgcaattgacaccctcaggtgatgaaaaccttggagctgccacaggccccaactcctcccagaactaaaccttttaccagaattgcttcctgcctggtgggcacccccaacgattggctaagttggatggaatctcccacaaggttttgtgcttttgtatttttaatatgctggagacagagtctcactctgttgcccaggatggagtgcagtggcacgatcacggctccctgaagcctcgacctcccggttcatgcagtcctcccacttcagcctcccgaatagctgggactactgatgagtgctaccacgcccagataatatttttatttttttgtagagatgggggcttactgatgttgcccaggctgctctggaactcttgggctcaagcgatcctcccgcctctgcctcccaaagtgttgggattacaggcatcagccactgcacccagcctcccataaggttttgatgaggattaaacgagatgatgtacacccagcagaaacctctactgttaccgtgtcccccttgtgttttagtccttcattttcttcctctgaccctcgaaactgtaaggacaaggagcatgcatgactcagcatgactcagcttggtgagcccagggcccagctcagcaagtagctgagttcattcttcactccttcagccacagcacctgacttacttatcacttcctttcccaggtgctgaggagaagagagcccagatgtgaggacaagagaaaggtggggtaagggatagagacggggaagacaatgagcaaacctagggttttttctggacattcaataaatgcctatttgagatgctaagacatgtcccccttttgcatctaatcacagaaatacttatatacacacatcaaaatgataaatcctgggcatgaaatgaatagttttaaagatgccaatttaggccaggcacaggggctcacgtctgtgataccagcactttgggaggctgaggctggcagatcacttgaggtcaggagttcgagaccagcctggccaacacagtgaaaccccatctctactaaaaatataaaaattagccagccgtggtgtctcaagcctacagtcccagctactcagaggctgaggcactaggatcacttaaacccaagaggttgaggttgcagtgagccaagactgcaccactgcactccagcatgggtgacagagcaagactctgtctcaaaataaaataataaataaataaatatgtcaatttaaattatcagccaggcacagtggagagagcctgtagtcccagccctttgggaggccaaggtgggaggatccctggagctcaggagttagaggccatagtgagccatgattgcacctggacaacagagcaagaccctgtttctaaaagaaaaaaaaaatctaataataaaaaattgtcctcccaaaaaaataattgtccacccaaagtagaaaattaactcatatactcattcatcaaacatatgtttggtacctacctaccaggtactttctatatttggtgcctccctttaaaaaatggctgaggagcattgaatccgaacccttccaaaacacaggcaaagatgacaagtgggctgcatcacacaccataagagtctgtctggaaatttgcaatcccataaacggttatagctcagccagccgctggggtgccttcgtctgtctgctccgtatgggcttctcagaggcagatccatccttttcttctgcccctgcctcccaccacagagcacaggaagagggttctgaaaagtggtccctctccccaagagaagttgggcacaccctctgcatccttgctccctggacgtccaggaggcaggagcagagagattggtcaggtgcttggagccataaggtcactcaccttccattgagaacacactgaccacagctcccaccacctgaaccaaagttcatttcgctttggaaattacatgaagcccccaaacagaaaacacttggcaactgttcgtcagtggctctcattcatcttacctttccctgaaaataatttctttttttttttttttttttttgagattgagtctcactctgtcacccaggctggggtgcaatggcgcaatcttggttcactgcaacctccgcctcctgggttcaagcaattctcctgcctcagcctcacgagtggctgggactacacgtgcgccaccacgcctggctagttttttaaactcctgacctcaagtgatctgcccgcctcgacttccaaaagtgttgggattacaggtgcaagccactgcacccggccctgaaaataatttctataggacctgaagatgggtactggtatgtggatgtctctagattccttaatcccatcagctgtttgcctggaaggaatggtgagattctagaaaaatcttgtgacctccctctgaccccaggtttcctcatttataaaacggcaacaataatgtcttctgcatagacctaggagatgtctatggtggctgttctattcaagaattgctagctgtctttctttaatcaggcctgtccgtatttcacctcagggatgcctgggcctaagttttattaattgaactgtttttgttgtatatcttttatgaagagtcatctaaactttggttttctctgttttcctgaaagcagcagtattttaggtttcttagagaagaagaaaagaggccaagctcagtggctcacatctgtaattccagcactttgggaagccaaggcgggaggactgtttccgctcagaagttctagactagcctgggtaacatagggagaccccatctctacaaataattaaaaaattaatcagatgtagtggcatgcacctgtggtcccagctgctcgggacgctgaggcaggaggatcacctgagccagagaggtcgaggctgcagtgagctgtgatcacaccacagcactccaacctaggcaacagaagagaagaaaagaagaggagactcttagtggagaggaaaaaagaaggggagaagggaaggttttcttacaataaaagtaacataatcacattagaaaaaaacgtgaaaatgagagaaagggaaagaatatctccatattcttatctccctcacacaacctctgacaccattttggtctatttcctcaaagtcttgtttcctataaatgacagatggttttctaagtctcctcacagcctccatggccctgactttgaggggccgtgtaatattccaccatgtggctaaagcataactggtttaagtacgtggttactgtcagacacttagattatttccaatttattttgttactgtaaaaagctgagctagccaggtgcggtggcccacgcctgtaatcccaacactttgggaagccaagcgaggagggtggcttgagctcgaatttgagaccagtgtgggcaacacagcaagacttcatctctactaaaaataaaaaaatgagccaggtatggtggcaggcacctgtggtcccagcttctgcctctagagatggcacttgccaatctatgtgagtatctgtaattactccagaggattctgaagaagcctatggaatcaaattagggaaccactgctgttcccaattgaattgaaaactgaggtactcgggaggctgaggtgggaggattgcttgaaccctggaggtcaaggctgcatcatgatcgtgccactacactccagcctagttgacagagtgagaccctgtcttaacaacaacaacaacataaagctgagctaaaaatctttatgcaacattttgtccatattttttactgtttttcttaggaaagattcccaaagtgggttccctgggtcaaaggttatgaagatgttcaaggctctggacatcaattgcaatagttgcccagaagggtcactcgaagacctggttggccaccagcaagaaaatgcatgcaccttcactggggtgacacctttcacaggcatcacagcgcagggtcagggacacctgttgggttttctctggagtgagttcttatggaacattctggtctctgcacattagctgcacaatctcaggtgcttttcagctctgccctgctgaatgagagatccataatgcatgcgaggataagctccaaggtggaatcaaatgctccctcctcacccagcagctatttggggatgatcagggaaaacgaaagatcaggttcctcttcttttggttttaggtgtccaaggtgttgggacaatgatgagtttatctagggagaagcattttccaaccacattgatcatgggggacagtgggggacgttcaaaggtcatacctcgtttattcctcatttattctgagacaggtccactcaggcagggcctcaaggactatgggatcaaatccaaaggcccaggaggccgaagccctttcagatcaactcctggatggggccttcaactgcagatttgagacgtgcaggaacaatgacaaagtcagaaggggcctaattctaggggctgcggtaaccaaaaagactctgctttatttatttatctatttatttattttggcctcaccaggtcaagaaaggctgtctccctctgtccactctgtctctcacagcagacaactagacatccagaaactctctccaaggttatcacactcaagcatgagagaccctcggataatcacacatacacaggtaacacccccactgggtatcaagacaacttagcacattccgaagatgccctcagtgcatcaaacatacaatgggattcctctgtaccctcattttcttttttattttttgtttagagacaggggtctccctatgttgcccaggttggtctcaaactcctgggctcaatcaatcctcccacctgagcctcctgagtagctgggacggcaggcgtgtgccacccagccataccctcgtttcactgagccgaattcagctatactcaaagggccaaatgcttttctttttccattttaaaaactttaaataatataaaagtgtattttgcctattgtatttatttgtatttgtttctacaggtttttttgtttcttagtgtgggaaaactagaaagcctgctggacaaattctaaaagagctatagtactcttttttctattttttgtatattgtgcattgtactttatcgtatattgtctactgcagtttcttttatgcattgactcactgatgttcctgtacagcgtcacacacacaaccagcgcatggaaaaccaaccttcaggaacaactcgggagattgtcaggaatttttttttttttttttttttttgagatggagtctcgctttgttgcccaggctggagtgcagtggcacaatctcggctcactgcaagctctgcctccccggttcaagtgtttctcctgcctcagcctcccgagtagctgggattacaggcacgtgccaccacacctggctaatttttgtatttttagtgtagagacaaggcttcaccatgttggtcaggctgttctcaaattcctgacctcgttatccatctgcctcagcctcccaaagtgctgggattacaggcatgagccaccgtggctggccaggaattttttattttttattttttgcctactgtgctgacttctgaacttcacagaattttttattttttatttttttgcctattgtgctgacttctgaacttcaccatgaagatgtgactctgttgagcagagtttcttctcctttggtgcttttaggtcttgggggcacgtgtctgtctgttaggaaccagcggaaaatcagcccagctcggatcagaacaggaaaccaggacccaggctggtgggtgctagggcagggccttgtggcttcacaacccgcctcccagggacaggctatctggtcaaaagaactcgccctcctcactgctgggtcccttagcgggctttcacgtgcctggcctggtccctccttctttaaatgaagagtggcctagatgattgtcacactcctgtgtgacactggacaacacacatcacctctctgggcttccattgcctctgaacagtcttccaccttcgactggaatcagagccccaaaagcgagattctaacaagaggttacattgtgtgagatactgacctcctcagcatctagggtgatggggtccccgggtgggtcacctctagctgggagatgcttcctctttcacagctccatctgtgccttaaaaattaaaagctgggaacctataattccagcactttgagaggctgaggcaggaggatcacttgagctcaagagttcaagatcaacctgggtaacacagtgagacctcatctcttaaaaaaaaaaaaaaaaatgtaaaggctggaaaagatgggactaggtgatctccactgtcctttccatctcacaccagccaccccacgcccaacaccctcagaatagatgacaacgggcagattacccttaacagatatttctctaacccagtgacagggacctctgcatcagaatcacttagaatgctcattaaaaatatgactccaggctgggcgcggtagctcatgcctgtaatcccagcactttgggaggccaaggcaggcagatcacttgaggtcaggagcttgagactcacctggccaacatggtaaaatactgtctctattaaaaatacaaaaattagccgggcatggtggtccacacctgtgattccagctactcaggaggctgaggtatgagaatcgcttgaacccaggaagcggaggttgcagtgagccgagatcacgccgctgtactccagcttgggtgacaaagtgacactctgtctcaaaagaaaaaaagaagaaaaagaatctggcttgccgggtacagtggtgtgcacctatagtcccatctacttggggggctgaagtgggaggatcacttgaacccaggagagtgagtccagcttgagcaacgtagcaagactctcatctcaaaaaataaaataaaataaaataaaataaaatatatatatatttatttatttgggaggccgaggcaggtggatcacctgaggtcaggagttcgagatcagcctggccaacatggtaaaaccccgtctctactaaaaacacaaattatatatatatacatatatatgtgtatatatatacatatatatgtgtatatatatacatatatatatgtatatatatatgtatatatatacacacatatatctggaacctcccacccaggaagtgtaagcacacccaaggtatgagcagattaaagaaatcctgcagaagggggaacacatgcatagagtatgctggcaaggtcacatatagaaaatgggtggggggacttgaaagcagaggtataaatcctatgtgcaccttatttgctcaagtctacatggaccagcatccaaacattgaaattttcctttcaaattcaatcccccagagtgtatggtctcaggacccttctttcccccaaatcttttctagtggggatgcatgtatgcagacaatgcaaagtgctacaaatcgcaacaccaaatgcatcaagaggtagattattagtatgagtcagtttcacactaactttaccaaaaacctcactgctcacattagctcaagtaatctacttacaaccacaattataaattctgagcttccttggctgacgagtttgcagtaggtggttcttggccctgagggctgctgagatgcccgccgttatgagatgcccactgagaaaaccaccgccctctcccagcagggtccagcaggagcagtgtctgctctcggctacacaactccattcatagacttttccagttacgtttgaggttcacccaaaggaggtagtaaaaacaggaggtgggcactgaagctggcctggtatgtttgaattccagctctgctttttatcagcctccaggttttctcagtttcctcatctgtaaaacgggaataatattacctgcctcacagagttaccatgaaagtaagaaataaaatattcaaagtatatgacatggctgggcgcagtggctcacgcctgtaatcccagcactttgggaggccgaggcaggtggatcgcctgaggtcaggagttcgagaccagcctgcccaacatggtgaaaccctgtcgctactaaaaatacaacattagctgggcgtggtggcacaggcctataatcccagctactttggaggctaaggcaggagaattgcttgaacctgggagacggaggttgcgctgagccgagattgcaccattgcactccagcctgggcaacaagagcgaaactccatctccaaaaacagcaacaacaacaaagtacaggacacttgctccatgctccataaaagaaagttaatattgccataaaggagaccaaaaaaatcacagaaacccacgacgtgatcctgatgggagccctgttaagaggggcttccaggccaggcatggtggctcacgcctgtaatcccagcactttaggaggccgaggcggccagatcatctgaggtcaggtgttcaagactggcctgtccaacatggtgaaactccatctctactaaaagtacaaaaattagccaggtatggttgcgggcgcctgtagtcccagctactcgggaggctgaggcaggagaattgcttgaacccgggaggtggaggttgcagtgagccgagatcgtgccactgcactccagcctgggtgacagagcgagactctgtctctaaataaataaataaatagaggggctttctgccaggtccatagctgcctgcacacatagtccagaaatgtgacctcactccctagctcctgctccactcgccaccatcaacctgctggcctgtcattcatggtgtctggtgactctccctgccatcccattccaaacccctcagaaaagcttatccaattcctgagtgaaaagaatgggcctagaagggctgagtttaagttaacccaaagaaataaacccaaactccttcattctccaagctgttcaggcctcagggacatgtgtggggtgactgtggggcacacactatcattccccatgtggatccatcacggggcctagcacacaggaggtgcacactcagtgactgttctgttgttgaatggcaggatgaatctcactcctccctcaagacctgaaaacttgagagttatgaaggcatgtttaggaatgactgtaaaataccacttttcagaaaacacagaaatctccatttgattctttcatttgcaagcctgtttgatctgtctacacactggttggtctctcgtgtcccagaagcagagggcaagacacaaaaccagagttcaggggagcaaagcagacattttaggaagttattgcccaagtttcacttccacgtcgtcttctgcattctacttcaactctggttttgagcaaagctggggctggtgaagaaacttcccttagtctacatgttcctctccctgagtcccagcactgaggctctgtagaccagggactcaaattactgagcactcactgatgctagaccctatgtcaggcatattcagacatcttctgacctaagagccacaacaagctggaaaacagacactgagatgccaagagaggttatgcaatgtgcaaaagacttcacagtcagggagtcgggtctgaatcaaagatctccttggctccaaggtccttgcttctcaacctgccactgtcctttttcaaaggcgccaaccactaacatggcaaagtgtttcatttttcataaagccatctgaggagttcaaaagcatctttttttttttttttgagacagagtttccctcttgtcacccaggctggagtgcaatggcacaattttggctcattgcaacctctgcctcccaggttcaagcaattctcctgcctcagcctcccgagtagctgggattacaggtgccagccaacacgcccagctaatttttgtatttttagtagaaacagggtttcaccatgttggccaggctggtcttgaactcctgacctcaggtgatccacccgcctcggccttccaaagtgctgggattacaggtgtgagccactgcgcccggcccaaaagcatcatgaaaaactgtccccctgcattaaattcagatcccatctctgccagaaggatagccctggacaaatcatacagctctcacccacctgtgactatgccccatgggagaaggacgtgtatatggaggctttctgctagactatgctagatgctttgatacacattatcccactcaatcctccaaacattccagggaagcaggtgatagtagcccagcttcatcaatgacaattctggttctgcagtgggatgtgatttgcccaaggtcatgcagcgctgagaagcaggcccagggctccatcagccctgccatgcaataggctttgttgagtgagcactggatgtaaattccaaagagcttaaagcggccagacagagccagtgacaggagactctattaggcagatgaggaaagaatggagcttttcttcctcctaccgcccaagcctttcccatccttaactcctctgcacaacggggccctcactgtccttcccccaccttcttatcaaaggatgctggtgctgggagggggaaaagacagaaagaggattagtctctggcatggtttatgttgatttcaaagctgtcacttttcccacattgggccttctttttcactgtggatttaagtgcctagtcccctgatgaacgaaggtcaagggcagaggtacattttgaactagagaaagtcctcagcatcctcctgctctcacagccttactgctaaacacagcagtggatgcagagggtggcactgtggagcggtgagcaaaaaccaggctcaggagccagaggcctaggttccagtcctgactgtgcctcttggtcaagatgcttccccccaggaggtcccagttcccttgtgtgttaaaattagagtactggatgcttaggcctgaaactctgagtatggggtttctgctcagtccttcagctcacactgcctctcctcccccgctccctgaaggcagccccatctcaatggctcacagcatctaggccctcctgggcttattcagcacctgctggcagacagaggtggtctctctcccaccccttcctgctcccactgtcacctgtcctgaggtccatcctaggcctttgtcactttgtcatatgtgtgttttcgcatgcatgcctcctcctctaagctaacttggaaacctccagggtcatgtagagatttgcaccatcagcatcagcctggctcctgaatgaatgaaggggagagggtcaggttggatgatctcctggcccactgcactcaaagtatggtctacaatccagaggcatcgcatcatgtgcaaaagtgttcaaaatgcagcatctcaccctgccccagcccctgctcagaacctccgaggcaatccccacgtgatgcgcagcacactcaagtttggaaagttctcttccaactcctccctcccttgcttctaccacctagaagcctccggaactatggccttagcaggtctcactaaaacatagcccatcattaaccaaaagagatctgccttaggaaccttctagaagcccgccactgactctcacaagcagaatctgaaatgtgtgctccccggggggactcctggcacacattactcagtggccctctccgaccctcaaggaagcccaggaagctttcaagaacgctgaggcggccaggcgtaatggctcatgcctgtaatcccagcacattgggaggctgaggtgggtagatcacctgaggtcaggagttcgagaccggcctggccaatatggggaaaccctgtctctactaaaaatacaaaaattagcctggtgtggtggtacgcgcctgtaatcccagctactcgggaggctggggcaggagaatcgcttgaacccgggaggcagaggttgcggtgagctgagatcatgccattgcactctaacctgggcaacaaagcaagactccatctcaaaaaataaaaattaggctgggcatggtggctcacgcctgtaatcccagcacgttgggaggccgaggcgggcggatcacaaggtcagcagattgagaccatcctagcaaacacggtaaaaccccatctctactaaaaatacaaaaaaaaaagaaagaaagaaattagccaggcatggtggcgggtgcctgtagtcccagctactcgggaggctgaggcagaagaatggcatgaatccgggaggcggagcttgcagtgagccgagatcgcaccactgcactccagcctgggcgacagagcgagactccatctcaaaactaaaaataaaaataaaaataattaaaaaaaaaaagaacgctgaggcctggcagagtcagacagactggctgcccactcacccacacggatcccatgtccacgttcagaaagctctcttccctcatttctctactcttgacatttattcagcttgtaaagaaaaggatcctttccaaaacacgtcttcagttttttaataaaccccgcaattcctttaatgatttcagattatcttaaatatttataaaaatcactctcagcaacacttctttaagcaaacctcctcatcaacttcgattatttatatatttatgaacacgatgttcaaggagcagatggcagctagtaagtcctccaaaagaaggaaaaaaaaaatcaatgggacagaatgtaagctccatgactcgtccatgtactcttctcgacaagctctggtacaattatctttccattcagcggaagcgccacacaaaagtccacaattggtttaaaatagcacacttggacttcataaagcttggaggctccaagtttaatccaggaatgacctgccagccaagggctctattcccaaaggaaactgaagctctgtcaggggagggtaagacattggatgcagggacagatgatgggaccaggggagggacagaaagagcaccaggggctgagggaagaaacagacattgctgagcacctctaggtgccatgctctctgctgggcactttccatacaacctctgggttgatcgtcacagcaacacttccaggtggcgactgttagtcctcatttgaaagatgaagagaaagacaaagagaaaggaagtatcttggccaagggcacagagctagtgagtggcagagccaggatgtgaacccaggctgtagggccccaaaaccttcactgcctctagaaagagaaaaggaggagaggaaaaaaaaaatattgctctcaacctcatgcatcctaggctaacaaagttgcctttctttcagcctggtgaggccaatcacccattttaagactatcaaagacttaattgccaaagttctactgaagcaaaaggacctgatccatctgagagcccagagaaggatgaaaaacaagattacaaggcgtccgtcttcaacaggcctttatcaagtatcccctttagggaagagaaaaaaaatcaatccttcactcctcccacccgaatttccttctttcaagaagctccaattcaagctaaaacagagagatgaatctggcctttgagacgcctatacgcttgctgagcaaacagtgattattactgttgttgatgatgataacaataatcatggatggtgatcactattatacggggtgtgcaatgggaacaggggcctatgctaaggactttgcttatgctactgccaggagcaacacatccccgtgacacatgcgcccattttacagatgagaacactgaggctccaagaaggcaacaaacttggttccatgcacacgagcagtgagaaagaaaaccaaggcatgaatttggatcttactctcttactcaggagccctgggagaccaacggggattcttttgcctgtttagagatgaggaaaagagggggccgagagtgtagtgacctctagaaggctgcacagccaagagatagtgaaggtgtgtctgataaaattcatacttaaaatctgaattttcagctatacaacacttcctttacaatgctcagtggtggacgattttgctgaagacagccaagtcccagaccgccaaagccacatgaatcgtggtctcttcaattaacgagatggcagtaatgctgagcacgggtgaggccacaacctcctggcacccgcgtccctcgggcgtccttcctgttcttcgtgtgcatgggtctctggatcctgatataagagctgtcagggaccaggattccacatagggaggaaccacgggacaaccatttcaaggtcaactgcaggccagtgcgctgaccttgagatggaaaaagaatgtacatcctcaaagagcaaaggggaacccatcattcttctgcccattctgtcaaaagacacgtactgtttcctgcatgggccaggcagcaggtcaggtgccagaggaagcacaaagaccactcagcgtctgcaagaagaaaagtgagctctgcaggctgaagacttaggcaaggaccctcaatctgccccttcctgactgaaggtcttgggccaagtcctgcactctctctaagtctcaggaaaacgagaaccctagctctcctttacaggtaaccctggccactccacagttcagtcattaaaaatgaatctgggccgggcacagtggctcacacctgtaatcccagcactttgggaggctaaggcagcgaggatcccttgagcccaggagttcgggcaacatggagagaccccatctctacaaaacattaaaaaattagttgggcatggtggtgcacacccgtggtcccagctacttgggaggctgaggtaggaggatggcttgagcctgagaggtcaaggttgcagtaagacatgatcacgctacttctgcactacttcaacctcagcaatgcgtgagaccctgtcaaaacacaaacaaaatgaatctgcacatgctcaaactgcagcacgctgctgcacagaagggtctgcactgtctcttaaaaataatagtagcacttacgggggtcgggagttgggggacccacatagctaaggatcctaagagaggcacacagaagactttgggagctgagaaaggagaaggggtggctgtcagagacagcaaaattacttgaaaatctcccaaagtgaagggcagaaacatatattggcctttatctgaaaaccatttccaagtctccctgtgctggaacccacttcagcctcctgcatcacacactctgcccttctccgtgctgtgagcccagcaaggatctagagtgcaaattccaatgtgcctcctcaggaagaaaactcaggccagctgaccacttctgcatgccgaccaaggtagaaaagtcacctcttccgggcttcccccacattacaggaaccccaggcctgggaaaccatcccagacgtcagccctggctcagtcttggctgttggcctcagccagtcacctggcggtggcaatcaaaatgacgccttctttttatttttcccccagtgcaatcttccaagaatgggagagtctcaaagtcagagtttaagccctttttcacaagggagtcagtattttcacaagatggtcttcctcagagaggggaggagtccatccaacccagatagcaaaattgctccctggagatcctggatggatgttacagggcaaggaagccaaaatgtggaagcacaccgactcacctctcaaaattcaccacccactcgttcatctcacaattatctatggggtgcttcccacgtgcttcaacgcaccctttctaggtgctggggatgcagaaattcaaggtgactggcaatgacactttctatcactgcgccccctgcaggccaggaaatctacgctcgttttctcaaggccccactcgcagcagcccatttcacagacgggaccctaagactcagagagggtaagcgacttgcccaaggtcacacagctagtaagcggcagggccaggaattaaacatagctgcaaagtgcatgtgacactcccccgcagccccagctctatccctccgcacccctccacctcttgcagcagggtgggtagcaaaggcacactccaagtagctccagcatggtaagacctcgattcctccttcgttccactcctgacacaggacacacgtttcaaaggacacacaggtttttcccaaccccagtgtgtgtgtacacagccccaggaaagccctgcaggctgcaagggcacccacccgctaacactgaacttccatttaaaaagaaagataatgaaaagataaaaggcgaagaggaagtgctctttaaacacaggcgggtggctaccccaggaggaagtcttgaggccagtggagattttgttcaccccctctagttcctcaaatccaatgcgactggtcttccaagcccctgatgggaggtggccgggggccagcgctgctcccggggtcagtccccgcaccgacacccggctcgcaggaagggtctgccagggaccagccaccccgacccgagcgccccctgcctcgaggcgcacaaggcgccggctccgcagctgggtggacccgggcggcggccccgctgcgcgctcccctcgcgtccgcccgccgccccccgcgcactcgaggcgcctcccccgggacccccgcgcccgccggcccggacgcccccaccacggcggcgccccctgtccacccgccgcagcgcccggcccggcggcccggatggtacctccgcctctccccgcacccatcacgcgcgcgccccgcaccccgcgccctctccgggggcaaatcggatccaggggcgcgcgcgcgggccggccgggcggcggcgccttcagagccccggcacgtacctggcggcccgggcgggcgaggggagcgcggcgcgggagcgcaggagcctcggagcctccggtgccgccgccgccgccgtttccgggttggcggggctcacgtcaccgccacaggtttgcgagctgcccccgccgcggcggcagcagcagcagcagcagcagcccgggcgagtgccaggcgagaaataactataaaaggaagaggcgcggcgaggaggaagaggaagcgctgtttaccttcgagaagccgagccgccggcgctcgcacaaaaggaggacgct

SEQ ID NO: 988 - DNA, 177059 bp, Homo sapiens; identical to SEQ ID NO: 987

SEQ ID NO: 989 - DNA, 100280 bp, Homo sapiens
ttaggttccaataaaattttatttatgaacactaaaatttgaatttcatatgcttttctcatgccacaaaatattattcttttgattgtattcaacctttttaaaaaccatttttagctcacaagctgtacaaaaacagacggtgagtaaattggcccacagaccggtttgctagcccctgggcttaagagatctgtccacttactcctcaacatgcagagtgtgaactgtgtgaactgcataggccacagcaatcttactgcatccattcccgctgcatcattatttttgatttgtattcattcagtccaccgaagcattcacttggcacctctccaaatctgggtactgtgcaagatccttccttgggacactgaaggaaaatcagacacggcccttctctcaagttcgcagactctccggtatccagatactacggctctcatagtatcagaaaacacagccacaagcgcaggtaagtatcagaggtgttttacgagatacatgtatcagattcttaaggctgctgtaccaaaataccacaaactgcatggcttaaaacaacagaaatttattccctcacaatcctggaggccagatgtctgaaatcaagatattggtagggttggttccttctcgagactctgagggagaatctgtgacatgcctgttttcctagcttctagtgacttcctccaattcttagggttctttggctcatagatgcattgctctaatctctgcctccatcttcccatggccttcagctctgtgtgtctatttccccttcttttctaagagctagtcattgaatttagggcccaccctactacaggttgatctcatttccaggtccttgatttcatctgcaaaaactttttccaaataatgtcacacgtggagattcccagtgaatgtatctcctgggggccactattcagcctattacactattcttagaagatgcctagaaggatatggccaatgttatccagaaggcttcatgaaggaggtaatagaagctaacccttcaaagatgaaagttggcgttcattagagggtcacaaggggaggaagggaatgtcaggttcagggaccagccagaccagagctaaggaagtgacatcacatggaacaatttgtgaacagcaagcagtagggcctggctgcaggacagggtgtgaagtgggggagcagtgatcaggagggccagagagatcagcagggatgtgatcttgagaagctgtgtgtgccatgatctggccctattaatccagaagggtctgatggaagcctctgtgattctcttccatggttaaacattttaattgtattatacctcggatattcctaaatatttaaaacactggcatggttgaactagacaacctttaagtagtttgttccaaccatgagatttagatttcatgatttaggttttatgatcttaaactgaaacctgttagttttctaccactagtgagatcatggcctctgcttttctcctgggaagtccctcttataatcactctcttcccatgattaaagggctactctgccttcatgttgctacccgctcccctggaaatggagaatcaagcaaggatgcggttttccttccattactacatccatacaagagtaaatcaagaataaaagtccagttaatgaaaagatcactggtcttaatatacttagcaaaattttaaaggcaattaaaagtatatacatagacaatgatcaaaattctaatgaaaagacccggctctcccctaaaagaagaaaaaatcatgtaatgtatatatgcattccataaaaacatacatggggaaaacttcagaagcctaaaaacaaaacatcagtaaaccaagccacacttagaaaaatgaaagctgatttttattttatcatcaacagccattctttagacatgaacatgcatacgtaatattctacgcacacatcacagcttttaacgttagttaataaaggttaaacacacaacatacatccttacaaaaaaagtcaaaatgcaaacttaaaactttaaacaaaagtattactaatttaaaaaaagtttgtgttgggtaccatttgtacaacacagttaatttaaacattttcattttggttgcacatgaaaaaggcggcagtagaaaataaagtcattgagggtttttaaatagcagaataggcagttttgccatgcaggagaagcaatattaaatattagtttcaaaaaaaatccacatttaaaaatatttagttcaagtcacagaatttttctcagtagagaccccaatgcaatgcataattagctgccttagatggcccgtttgaaaggatgatatcccttcagagtgtaactttactgattttggcacagaaaagaagtcttaagaacatgattaaaaaagagggaagaggaacagaggaaagaaataaaagcaagaataaatgagatagtaattgcaatcactaaaaaactgcattctcagtcattgcagaatactgtcttctgtctacagcaggtgcttattccagaattgttattgcagcatggatttaatttgcttggaggtagtctcatcattcaaatgttttgttgtgtacctaaaaaaagaaaagaaaaaagatcaattttaggaacttaaaaaataatcagcatcgggttctctaattatgacaggatggagaattggtctcagcaaaactcacaaaattatggcttctcattgtagctttaaccctgttcaggttctgcacagcctgtcatcctcaccccctttctaactgaatagccagtagctatttagcagctatttaacttagttacaactacactgctgaaatgattggttgacctctcaagtaaacaattagctgtaacttctccctcagaagaaaatgctgttctatcccagaggctggcaaattatagcccatgggccatccaatccaccaatttttttgtggactgtgagctaattctattttttaaccttttggatgactggggggcaaaggaagacaaaaaaagaaatagtaatatttcatgtgttattgtggaaattctatgaaattcaaatttcagtgcttacatataaaagttttactgaaacacaccaagttgactcattcatgtatcatctatggttactttcttgttatggtggcagaggtgaggagctgtaacagaaaccatgtggcccacaaggcctttaatatctacttactctctggctctttacagaaaagtgtttcaaccccttttctattctgtatttaagatgcctcaattactacagctgttatatctctaaaatgtctcaattctcccaagtgccttatttctaggcatgtgttttgctacatgcatgcaaatccaacataagaatccaaaaaagaatcacaaagagtgattattataaagattcacaacagtattcccttaaacagtaaaaatccactaagcaagcttactatgtctcaggcactgttcaaggagcttacaacctagcagacggagaaagataatgatacactaatattagtgacagggtaaagcctagcagcaaaggagagaagtataacaagaagaggctacatacagagacagggaaacaccatctcccatggacacccagaggccatacatagtaaggagtttggagattattttaagtgcagtaaaagccagtggagcatattaagcaggagaggggtgtgctgccacttaagttttatcattctggctgttgagggcaagctgtggagaacagaaggagcagcagggaggcattaaataagggggctgttactgagcaccaagtgtgagataatcagatgtcaaggcttgggccagattacagcagcaatggagacaggtgttcaatgcgtgaatgtggactgtattttggagataacccagacagagaaatctggttcacaagaattccacatataatcttaaggactagatcgttttttctagagataaggtctggctatattaccccggttggccttcaattcctgggctcaagcaatcctcctgccttgggctcacaagtagctgggatgacaggtgtgtgtcaccatgcccagctaggactacatccttttcagcaggtccacatagatctttctgtgtttaagaaatttaaacccaattcctattaggttcatttcaaattaatttaaaaaccgaagaatgcttattaagtacctgatatactgtctacaatgttactgagaagtcactcccaaactgttctcatgtttttgaataggtatcagcgtgcctggcacataaatggtgctcaataaatacttgcggaaggaagacaagataagcagccaggttggaaagaaaaaaaaatccataaaggaatattgacattaaatgctaagtgatgtcacaaggatttaacctttttgttctctttatgtagataaagtatacgcaattacacgaaatcctacagatgtctcgtagttctcaaaattcttcatttgtttctcctccacttctttatacaactaaatagtagaaagagccaagcaatgtgcacagtaaaatttctactgcagagtagttaaaagtatcactactcagcaatgtactgtactattcaaagagtgctaagtgttttcctctctacccatgacgcaagttctcgctccttctgtgggatgtgatcttggcttccttctttggacaaagccaatccagagcacactgcatcaccacactcacttatcaagaaaaggccaatattatctaatatacgtgaaaataaaacatgaagatatatggcattattttcctttgtgcacaaaaacaaattttttttccaagtgcgactgttttactaaagaaaaccaattattatttacctttactcttaaatttaataaagaagacaattatctactactgaatctgaactcccagctctctttttttctttccctcttatgattaaatgtatttggttccatttttccacctgtaaaatggacatatgacttgatgccttctcttagtagcacaggaagttctatataaataattactacaggaaagcattcaaaacaaacatatacatacatatggaactattctctcatttaaaatcttttggtctttaagttctattttgtggaggtgtgtaacactcgtgtagtacttttggggttacaaaatgctttctaaacatgtgctctcagtaaaacatattaaaggctagatggatttcctttaagaaatatttttcaaagtatcagcattatctacatcagctagggtgtttgtttaaaaggaaagtgcctgagtcccaagtcagacctgattttgttgtttctaaaagcaacattttattttctagtttccattatctattataataggaaagaaaatgtaccaaactgacaggtgactcttgcctccgtggtgctttccttccctcccctctccctcaaacacagattactttgtgggagacttcaaccctgtctttcactcgccatcactggtctcctctgctttcattctaaggaaaaggaaactgaactacccttaaagtgaaacgtagattctgagttaggcatactaccttcaagctcaagaaagaatcctaaaacctcctagatctcaattaccttcaagtttttaaaaaagatttcctgccacttgctggcttcaaagagcctgaccaatcagaaagacaaagtcttgggagaaaaatcaggttgactgagacacagggagtattcagaaagaaaccaaggaggaaagactcatgatatcattaaatattggcaaaaccactgaagtatgcgttgtaaaaaccccaagaatacagaattctaaaaactaggcttatggttaaaatagtttgacattataaggattttaaattatgttccttaatcttgctgatgttcatttagaatagatcacctttattcaggcagctaccgcttatgcaacacttttcataatcttttaaaaactatttttaaacattttttcataatcttaataaaatcatttgacagttccgcttagctgaaatgatacagcctacattttatgtggtaaatatcattatataaatatttctgtgttcatgtaatttttgtgtttaaaccctcaaaaaatcaagtaatgggacatcatcttttatgtcatgtgaatactaccaattaaatctctgtagtcaaatgttataaagtatcgagattttcatttaaaaatgttctagcagctgggcacagtggctcatgctgtaatctcagcactctgggaggccaaggtgggtggatcacttgaggtcaggagtttgagaccagcctggccaacatggtgaaacgctgtctttactaaaaatacaaaatacaggcacatgcctgtgatcccagctactcgggaggctgaggcaggagaagcacttgaacctgggaggccgaggttccaataagccaagattgtgccactgtactctagcctgggtgacagagcgagattccaactctaaataacgaaataatgttctagcatttgtagaagtttgagcaactaaattaagtaaaactaatctaagaaaagacattaaataatgactacttaatttttattgtaggaaatacataaaaataacagaacacaagtctgagcacaaatgtaattacattctattaagaggaaagagctagttacaagccactttgtaagatattattttgtaaaaagataactactacatagagctattatctatatatgtaaagaaaaaactctggaaggctatatgctaatagtggcttatctcaaaatggtgagattacattatttctttttatttacattttcttatgttttctgaattttatttataactggtatataatacttttattacaaaaacaagcaatctctgtttgaagagaagcaacaagtaaaagccaaaatcttcaaccagaaaatgaagctgctattgtcatgtgtcccacacattcctcatcataaaataccgtaaccagtgtttggaagcaagattatcaataaacaaaataagatcttcatatttctagcttgaacacttatttttatatcctattcacacttaatgcattttctttacataaacatcgaccattttccttacagattttttctgtacatacgtacacgtacatatacacacctgagagcatttagaagaccttccacactattaggaggttggtccttaagaactttgatacaacctttcatctaaagaaaaagaaaacagaaaaggtaaaacagccatttttttcatgtaacattccttttcaaaatagtaaaataaatcaagaccataactatggaactcaagagattacatactatgtcaaattaattattcttagaacagaaaaaaacccaacctaagagttattattctcacttagtgaaaacaaaatctttttgagaacaaaatcagtcaaactaatataccacacatgcaatgaaaaacaaacggtttgctaagggaagacttctggaaaaggtgctgagtggcgatttaaaggacagaatgggctgggcagggtggctcaggcctgtaattccaacactttgggaggctgaggcgggcggatcacaaggtcaggagttcgagaccatcctgcctaacacggtaaaaccccgtctctactaaaaatacaaaaaaattagccaggcgtggtggtgggcgcctgtagtcccagctactcgggaggctgaggcaggagaatggcgtgaacccaggaggcagagcttgcagtgagccgagatcgcactactgcactccagcctgggtgacagagcgagactccgtcacaaaaaataaaataaaataaaaaataaaggacagaatgagtatgttactaaggaaaagaagaactttcaggtagagaaacctcacagagtaaagtatcacacagaggacagataggaatttttcagcactgcacctggagttatgagaggctgaaagccaggatgagttatacgaagtgttatgcctggcagcaggggactcacaggttattttaaaaggtaaccacttgatgacgatggtatttaagatatattagcctggttgttataaaaaagcataatacagcagaaagaacacaggctttggaagccagagaaatgtgggttctaccttttctagcaactctttttatttttgagatggagtctcgctctgtcacccaggctggagtgtagtggcgcaatcttggttcactgcaacctctgcctcctggatttaagcgattctcccacctcagcctcccgagtagctgggactacagatgtgtgccaccacacccagctaatttttgtattttttttcagtagagatgaggtttcaccatgttggccaggctggtcttgaactcctaaccttaggtgatccgcctgcctcggcctgccaaagtgctgggattacaggcataaaccactgcacccggcctactagcaattctattacttgatctgctaaactttagttgccctgtcagtaaagggagatgacacctaaaagagtattttcagagtcacaagggagaacaaacgtaaaattcctgggacatggcaaccatacagtaaatattaactcatttctctttacatatgacaggtgtacatgaaggcaacaagcttggctagtaatcagtaatcgagatccgaaatgctaagagcctaaactagctatgaaagggaaacgggaagacaattctcaccaaacactaatgaactagatgtgagaggttggggaaagaaactacgaagtagagaaattagaaaactatttctaatacaaacttttacagagagaagaaaagtcgagagccaactatagtcacaaattattatgactaggtaggggagggaaaatacataaagtcttcatctttttccactggagcatcctactggctgtctttttaatttcaagacagggtctctctctcacccagactgaatgcagtggtgtgatcgtggctcactgcaggctggaactcctgggctcaagggatcctcccacttcagcctctcaacgtagctgtgactaccgatgtgtgccaccacacctggctaattttttttttttttttgtagaaatgggggtctcactatgctgcccaggctggtcttctactcctgggctcaagtgatcctcctgcttcagcctgccaaagtgcttgggctacaggcatgagccagcacgcccagcagcactactgactttttatatgcattctgaaataaacattttatttgaaatggcctttggccaaaggaattaaaggatatgactcaaaattccttatatctaattatctatttatattgccaaatacgtagtagaagccttccaggaggtactcactagacaatatagtcatcctttgatcattctattccacctgaatacaggccacaagaaaaacagcacagggacagaggagatgaaagtccaccatttcacaaactataaatctgagttttgtgagagtccggtttgctggctcttatcataaaataaaatcctatggtttccatggagaaactcgtttgaaattatttatataaaacaataacttacatcaattttggaagttttagcaaatgctcccactggatgtacgtggtcatagagtattatgacacccaccattaccctcaagcagaatgacactgtctcttcatttgtaaatctgcttctgtattccctgaagagtagataagatatgcatggaagaagtgcattacaaaattctttttaaaaacacacacacacaagaaaaacctcttctgaaatattttattcaaatttctatccattagttgaatgcagtatgttcacaagtagccacactgatacattcaaatcttatgtctgttttcctttccaaatcaaccccctgaaagggatataaaattctttaatgaggtgattcaactttcagctgatgctgacttgcccctttgatctctaaaaggtatactaacattatgccccttactccacaatgagatccccagagatatgagaagatggtgagtggaacagtcatcacccatgtattctggtttctataatatctgcacccacattagtgcactgctcctctgctagaccgatagcaacaattttagagaatagatgctacgtaatggttgttagcacctatagtgaaaaatcactagcttaatagagcaagcaggtttgctatttaggtgctaacttgatctaaatacattatagtattactggatatcaattttactaaaactcaatcatattctcctctcatttgtgaaaaagaaaattgaacttttatctatatatagaaggcagtatatcatagcggaaagagtacggaaccaggatagagacatccaagcacatggatagtgtcccttcatttcccaggacctcactccctgaagttggtggtggggggaaggaagatgattatgatgatagttgccctcctatttcataaggttttccaatgagatgatgtacagtatagtgctttggaccatcatatatgtggcccattgttgaccaaaacgtcattaagcagcacatgactgtatttattattctggaatccaggagggattctttctgcctgctaacaggaaaaatccagccaggacacactgtatcatacatcataaatgtttagagaggagagaaaaaaaaacagaattcaggttcgtgttggaaaaaaaaaagaaaagagtgacaattaattattgagagaaaaagggataaacagaagaataattccagccctttggcaaaagggtaagattctttactaaatatggaaaaagaacatttatggtaagtataaccaaggaactttaaagttcttctcctacatcccagccaccaaaacaccaccaccacttctgttctgagaagagaactaagagtctgagtcagtctgagtggtctgaggtacctgaagaccaactaactctattttatacttaaccagaagttacgttaaatagccaaattattttaagtttgttcatatattaacattcaatatttggaatatacttactttccaccttccagataaaacatgttaacatgttcatatatgaacatgttttgaaatatcagtcatctcaacagcactgttaaagtgaaaaagatcagctgatactcacggtgtttccagcatgactctgcatacactagccattgtgcttaaacaatctgtggtattttctattggtaaatttttattctgtagaagtatatgaagaacaaaaaaagtaaaagtaacaaacgttattacttaagcacaatttaaaatttagcgtaatatgaaaaattagcaactttaaaacctggttcctactcctaattttctaaataatgcactagactctaagcaactgttccaagcactggggatacagctatgagcaagacagcgaaggcaggactcttctgaaaggcacctgcattccagcaatgtaagaacaactgcaacaatgcagacagggggtcaaaggtgtagagttttataggctatgaaatagttggattttatcctaagggtactaggaagtcactgggaacattttacatggaggagggagggaacatggtttatgttttaagattacttggttgctctatggagaaaggactatattggggcaagagtggaggaagtaagaatggtcaggacacgaatgcagtaatccagatgagaagtctgatgtggctggtggcaagaaagcaacttaagttttcagaatcatgatatattagtattttggagggaaagccaatgagactgtttgatggaatacatgtagggagtgaggtatagaaaggaatttaggatgatggccaggcgcggtggctcatgcctataattccagcactttgggaggcggaggcaggcggatcacctgaggtcgggagttcgagaccagcctgaccaacatgcagaaaccccatctctactaaaaatacaaaattagccgggcgtggtggcacatgcctgtaaccccagctactagggaggctgaggcaggagaatcgcttgaacccgggaggcggagtttgtggtgagctgagatcacgccattgcactccagcctgggcaacaagagtgaaactctgtctcaaaaaaaaaagaaaggaatttaggatgacataagttgtaagtttttgcctgcactggtactgttaattgagaaagcaaaaactaaagaaagggcagggttagaaaacgcaacccagagtttggtttggccatgccatcagctatcactgaggtttccaccatccctccagagaaactgcaaatacgtggacaggtgtgcacatgtgggcctcagaaaaaagtcaggactcaacacatacatctgggagtctgttggtttcaagatggtatttaatgtcttgggcttgctgacatcacgtctgccaacaggggcataaataacaacacagagtacctgcctaggcaatgcttacctctgatacaaattttgttgtggcatcactcaaggttttcagcattggagttgcctcagcataaaacaaagacattcgatttgccaattcattatttacttcattttctccttctgcctgtggggaaggtaaaagcactggatgttagttcacaaattattacatataataacaattatacaaggacccaggcagggtgcctgcctcaattacattttagactctcatgtatcgataatactcaaatattctttttaaaaaaaagttattttttttaaaaaaagattaacctcttcaaaaatattttaaatgatattaaagaatttaaataaaaccttgatgaactgtctactacatacaagagattctaaatgttatggaggacagaaaaatgattataaaattgtaccgtcctccattatgaacaataagtatccatacaacatccatggtaagattctaacaggtgataacacaaaaagggagtcagagaacattaagttggaacagaagaaactaaggagaagagttatccttttgcaggtcatattgggcaggtaaacaaggtattccaatctggcaggggaaagagtatgttttcaaatgactccctaaagagtaattcagcatattcagtgtaataaggggctgcaaccaacgaaagatacaggttggggtcagactgtatagtgccataaatgctagcttaagttcatatttttcttccatgtggaatggggagccattcagtgtgttagatgaaaggaatgacaactaagtcagtttcctaaagaaaattaactgataatcgtgggcagattgtaccaaaatggaaaaagacttgtaggtccgaaaatgagttatgctgtgcagagtgactgccagaaagagtgggaattaggctctctgttggaacagtgggaggaggagatggaaagggggatggagaagacatttcagagatatttcacttgaaaaaaattggattttacctgtaattattgagggtaaaagggagaaccaagatgactaatgtctttagccttaagtgatggcaaggatgggtatagtataggattggctgctttgctttttgcttttatcttattttacatggtaggtatgaaaaagacagatgttaaggtcagtctcacacgaggaactggtctatgcaaaaatcaaattgatgcaaattacagatgtttcataaagaggaatcttttcctccaactcagtgccttagtgcaagtgcttcctaaaatattttttcaaggaaaaagaaaatgaatgatagtctttgatatatatattttaaatatcttatgccacttattactccttacatagttacagtatttctctattaaactatctatttgaaacaagggttgatctttgaaatttttcagaccaattataaggttctcagaaacacagagaacaagttaatattttcttccgctctagttttacttatggtatttagttccttggaggtagaaaagagtaataaacagcttaagaggaggatggtaagaagttaagagacctaaagaagccagaagaaatgctatactagccaaggagcaggcacaaagccattttctcaaacagctatatcaggcacagatgtgttaacaggccatgacctcactatcacctcttgccagcattaaccattaatttcttggaggaaaacggacttgggttcaagatttctctccaagaaattaacccacgtcaatttctctccaagactcttccattctaagaatatagagacaaaaaactcgtaactatgaattcacagaatttctgtacagttaaaatgagagtacatcgcgaaattttataaggatcaacgttatacagataagcaattttgttgaagtagttgtgggaatttaagagactgtgaagaaaaacaggtaaacaccatatggtttgttacagtttgcttttcctcctacagctatggctgcccataattactaactttattactagctttaacactatctgaatgaacaaacaaaataataaaatgaacaggctgagcactaagttactcttaccatccccctaattcaaagcattaacttaccggtacattgttaatcctcatacgactcaatgttcttctataatagctgaaatcattctgtatggcaggatttgtcatctgaagaagacagttgtggaaaaaaaatgttatgtactaaatgctaatgtaaaaaaactaagtaaaaaatctttagttttaattagtataaaacattccataattcatagtatcattttaagaactagcactggtataatccaaggtggcttataactgtatttagtccttactgaacatataaaacgaaagaccacaggcagtatactttcccttttcttttcagttaatttcaggtaatgtactaaaagcttgtttatcaaataaacaaaaacaaaaaggactgtttaggcacttgtttttagttattacgataaaagtatgtaggtatggtcaacagagcaatcctcaaactagaattttacatacaaatctgactgtgatacaactataaaatgctgaagtttggaatccagctcttccattttctagacagggtaccagaggccctgaaaaatcaaaggacgtgcccaacgtctcatgactagggttactgtggcagagtataaactggaactcaggtctcttgatatgagacctagtgcttattcctttacattcattctttttaacaacaaggtatttatagttccaaacactataaacaatgacagaggaaaaaagaaacagaaagaaaggaagaaagcgggaaaggaggaagggagaaaaaagaaattttagcaacattttaatataaaagaatgttgaaaaacgggggtagagggtgtgagcagaaaagaaaaagtattagaaaaaaagctcaaccttttgtttcggagattaatttttaaacaaggttaaatgaagactgctgagacatgtggatcacctgaggtcaggagttcgagatcagcctggccaacatggtgaaaccccgtctctactaaaaatacaaaaattagccaggcgtggtggcacatgcctgtaatcccagctacttgggaggttgaggtgggagaatcacttgagcccaggagggagaggttgcagtgagctgagatcacgccactgcactctaccctgagtgacaaagcaaggctctgcctcaaaaaaaaaaaaaaaagattgagaccgaatactcagtaatttgctctttgccatgtatcaaaagacccgtcattaatttctaaatccagctttgcatttttattaaggtctagcagacatcatttaaatacattttaacaatgtttcccggctcttcctcctagtactcattaaaagattcatgattttcgtaacaatcagggccaatagataattctaccttgagttcatcaaaccggagtgtgaaatgaagaatttctgcaaactgtttagcaagagcctgctctcgctctagatgctgggtgggagaatatggggtacttgttaaggctcccagaagacctcttaatgctgcttctaaagaaaaaaattgaaaaaaacattaagttgtttgtatctgtgtgatatttgtttattaaaaagtgaacaattcataaatgttaattcccagaaaagttctctttaaaaaacagatgatctaaacataataaaactaattaagaagtttaaatgttgccattgctaatgtactacacacattctgaatactatttaacagaataaaaaccttaaacggactaattcaagggtttataattctgtaaacccagattgaaaatagtgcagaagtgaatttgaattcaacaccaaagggcaagttttatattactttaatcacttcacacagtgtggaatttggttttatgaaatggtaactattatctacagctgagtaactttcttcaatggcactgtgtccacactgtctgtatatgcctatgaatcaattaccaatttctcatactttgaatacatcctttatttataaccacaaactgtttgctttcagctactaaagagaacaaaatatgtggttcaataagcttcttgtcttagaacttgacatttcaagactacaatataaatattctaattcattatgtgagcaaaatggtccctttgaaataagtgctacttttgggatgccaggctaataaataccatgtttgataatggaaatactaaatactaatactaatattaaatactaaatactaatatttcatttcaatatttcaaaaagccatagaaatcaaatgaattcagttacagatcacagaactggaaaatgctgctagattctggtcagagaaaataagagcttacagagttaaactatgatctgatgttaataaatgtcagattaacaaacaaatattaatgataaatttaaaactttatgtcaggtcatcagcccgtaactttaaaaaaaccccagttttcctatttatgaagatttacgtatgagtcaacatctactgtacactgaatatagtctcccatttgatttttaccatcaactatgacatggtcattccagatggatcaaatgagtttcaaagaacttagagcccaaagttatagctagtaaatgctaggtatttctgactccaaagccctattctttctaccacaataaactgtctctgaaataaagcaacattgtacgtagcctctgtaactttataaaacattaacctcctgattactaccaatagtaccaattacttctgtaaccctacaaaacattaatctactgattaaaaacaatagtaggtacttcctgtgtgtctgtcagataccaggtactgaactatttcttcacagacattatttctcatccatgtaataactctaaatgacagctattatccttttttttccagtaagtctgaaaatgtactgactggctactctgtgccaagcactgggaaaatggatgtagacagacatgctccctgtgcccatatggagccttattatatagagagaagacagacaaatgattacagctgtgatatgtgctgaaaataagtacagtggaaaggtataaaaataagacctcacctaatggaaggcccaggaaaagatctccctgaataaatgactcctggactgagactgaagtatgtagtaaggatgaacatgagtttgcagacagaaaggcaggaagccagaccctgaactgagaagagcatgacatacttgaggaactgcaacaccaccaatataggagcacagagggcaaggaggagggtaaccaggactaagatgattcatacacatgtaatttgtggaccacattaagtactcgggctttggcatcctaatgtccctagagaaatcatctaagcagaggagtggcgtcagcagattcgcattttaaaatgctacttcatttgcagtgtggagcatggactataggggtatggatggtgtatcaaggtgtaacagtggatgtgaagaagatcaattaaaagtcaaacattttgggttatattttaaaaatggtttacttctcccaagattcattctttctgttggtgttaactggaaaactaagtaagagagacaccgaacagaaaaaaacatttttacaaaatattattatagtctgttaaagaaaaaaagaaaaatgcatctgcctagactttatcaagtctcagggttaatttcagcattccaagttctctaccacttttgggactggagtcaggtcgcttgactaagttgggatggtcagtgaccagtagttgcagaacttttgtctatgaatggctgaggccctccatggtagatctatgttgaaagggaagctcaagatgataaatctgctaatctgcctttgaagcagctagatcagcctcaccctgcaggcctgtgctggcacaagtcagtcctactagcctacaatgctctgtctcaagagagaaactggagacaatcccacagaaaatgtcccagaggtctctggatgagttggagagaaagagaggacaaagaaaagatgcctgggattggactcagatgaagctcctaaaacaaaaccatgagattatgattttttaaaaagcagatgaccaggagaaaattaatagtctattaagccctaagttctggaagaaccaaaggaagctggcagatgagtgcaggagccaaaaccacagaaggaggttgcaaggaaaagacaactagaaggaatgataaagatgacaaatcagtccacaagctaggacagggaagaataactagttgattaggaagaggaggcccctggggagagtttccctatagagacaacagtcgtttattctcatcaactgccatctatctactctcaaactctcagaagagaacctgaggacatggattctaaaggatttaagacaaccaagagtcatgaccacaattaacggtgggcatttggggcctttaaaatacattttgataaattctgcccagtgaaacgaagctaacatgttgaagggacttattatgacccttggaggcagtccctaatgtaagcccctaaagcatgagcaagactgaggggagacaaagcagtttgtcctactacctgaccatacaaccttcccttaggtatctgcctcaacaggaggggctccaaggcctcagaacaaaacaagcaagtacagaacaagcaagtatggcaagtttactgtagggtccagccccacagggtcggtgggtttctccccgtgtgcagagacgagagagtgtagaaataaagacacaagacaaagataaaagaaaagacagctgggcccgggggaccactaccaccaagacgcagagaccggtagtggccccgaatgctaggctgcactgatatttattggatacaagacgaaggggcaggataaggagtgtgagccatctccaatgatagggaaggccacatgggtcacatgtccactggacagggggcccttccctgcctggcagccaaggcagagagagagaggagaaagagcgaaacagcttacattattatttctgcttatcagggacttttagtactttcactaatttgctactgctaactaaacggcagagccaggtgtacaagatggaacataaaggcggactaggagcgcgaccactgaagctcagcatcacagggagatggttaggcctccggataactgcaggtgggcctgactaatgtcaggccctccacaggaggtggaggagcagagtcttctctaaactcccccggggaaagggagactccctttcccagtctgctaagtagcgggtgtttttccttgacactgaggctaccgctagaccacagtccgcttggcaacggccatcttcccagacgctggtgtcaccgctagactaaggaggcctctggtggccctgcctgggcataacagaaggctcgcactcttgtcttctggtcactcctcactatgtcccctcagctcctatctctgtatggcctggcttttcctaggttatgattatagagcgaggattattataatattggaataaagagtaattgtaccaattaatgattaatgatattcatatgtaatcatatctaagatctatatctggtataactattcttgtttcatattttattatactggaacaactcgtgtcctcggtctcttgcctcggcacctgggtggcttgccgcccacatttaccagggcagtgtagttaaaccctgtcagcaaaactgagtatcttcaaattaagcaggtaatccttgccctgtcccattgtaagtatgcaaactggcaagggatcagggtccttcttctgaagtataacccatggtgtatctgtagtgctcaggccaagaaaccttctccttagaactgcaagattctgaaggatcatgtgtgtcttcatagttgcatgctgctccatggtgctgtttgtgctggaatagcacccatgatgggacacacaccacgagaccgattaattcccatggtaaaaatataacacttaagtccaactagtttggcctattttacaattattctttgtgtattgggatatgctaaaagaccaagatgagcttgaatagcatctgagcaccatcaaaagcaatttaactataaatgcagccagaaaccagcgtaagaaaagctgtatatagtagagaagacaaccaagacagaaaacctaggctgattgggttataaagtgcaaagctacaaactatagagactcttgattgaaagacaaatactgtaaaataactaatactaaaattgggaaaataaattacaattcttatttccagtaagaaaaagataatttatacaatatttctatccaaactactgtctgtcttaacattacatttaacaggctgtactgcatctaaaggaaaaacagcaactgtcttacttttttttaagaacataggcatttttaaaaaatggaacttcaacttcagaagttacaaatacaaatggccaaatagcaaatataaatatagtaagatattaaaaaacatgaagcaataaaaacttattacaaactagaaagcacaagtcctaactaatggaggcagagatggtttgccatgtggttctggctctctaacatgcagatcaattattgctagttggaggcttaaagaaaaaaaaaaaaaaaaccatacagtgaccaagtgttaaacctggcaactaagtagaaattttcaaaattatgtgggccagacaaatcacatctctcaagtctaaatttagcttttgggtccccagtttgacttcagtcttacagtatataccccctggtttctggcttatgtatttaaaaaacaatcacagtatgattttcttatgattaatttgtaatgtttatacatttcaaaaattcaaactatatggaagtacgtgttttaactacattcaaatcgtcctaatttctgacacacatctatactattcctctcctgtgtctattcactgtacaaaataaagtgcttcacatttacaactttaaaatcaaacaaagagctaactggctaaatcttacctgctctgcctcctcctcctccaataaagggagttccaattttgcttactcatattgaagacacaattctgacctttgaataatttttcccaagcaagggaaaaagcaaactgttttgaactctttttgctttaataactccctagacaactttgggtatatcattagctttctatttctttctttcttttttgagacagggtctcactttgtcgcccaggctggagtgcagtggtgtgatcacagctactgcagccttgacctcctggactcaggtgatcctcccacctcagcctccagagtagatgagaccacaagcatgtgccaccacactcagcttatttttgtttgtttgttgttttttttttttttgagacgggattttgccatgttgcccaggctggtctcgaactcctgagctcaagcaatctcccaacctcagcctccaagtgttgggattacagaaatgagcaagcacacccagcctatttctcatcttctacagttttagatacatgaattaagcgtaaccagtaaaaatttcaagaaaacctctttgatttctttggatgctaaagggtcctattatgagaaatcacttggtagaatctctctccatcgctacagtaagtccttttcccatatatgggaaagtaatcctcaggcccttggttagtcaaacttttgtgttcttaaaatcatttaaaatcaatgctcagattcatgtatgtaaaacgacagatgatgaggaaaataacttgtggacaaaaatggtctaaatgaattaaaaggccagggttgaaagaagattaactataatcttacagtctaacaagcttgctttacttataaaacagatactaagccaaattcagcattatgaacataaaaaaactctaaacttctggaatgaataaacatctttttcactagggaagtcacaattacaaaactttcaacttacctaacctctgagaaaattcgtaaaatttctttaatttgcctactagtggaacaactgcaccccatgccttctcttgcaacttctcatctgctggatgctggattgccttcaaaatccaaagaataaaaatagttagagttaaaaaaaaaaaaaggttcatttttacattaaaatgtaggctttagcaaacataggaaacactggtataatccataaaatatagaatattgaatctaggagtgttgaatatttttttttttgagagagcgtctcactctgttgcccaggctgaagtgcagtggcgtgatctcggctctctacaacctctgcctcccaggttcaagtgattctcctgcctcagcctcccaagtagctgggactacaggcacgcgccaccacacccagctgaatttttttatttttagtagagatggggtttcgccatgttggccaggctggtctcgaactcctgacctcaggtgatccacccaccttggcctcccaaagtgctgggattataggcgtgagccaccacgcacggctgagtgttgaatattctatattgagtgctaagggtgagtcttctcaactccacagacactccataggagtgctaagagtgggtcttctcagctccatagatacttcaaccttagttagatacataactaacataatacattcttagttatccttgcaatagatatgaacataatgaaaatttaaaaatgatccaatatgtttgttaaatattttatgccttggtgcccagcagatccacaaaaaaaaatattgcatatgtttcccatatcacagagtctcttagtatttctttgtcaaagaattattttagcagtagaaaagaaaactcaaaaagtaagacaataagatgccaactctgggaacaggctaagaaatttccaataattaaaattccagggtctaaactagcattaagaaaactacctacgacttaagaacctaaatcaagctgaaactgtgatttaagaattgtcagctgggcgccgtggctcacgcctgtaatcccagcactttgggaggctgaggcaggcggatcacaaggtcaggagttcgagaccagcttgaccaatgtggtgaaaccccgtctctaccaaaaatacaaaaattagtcaggtgtggtggtgtgtgcctgtaatcccagttactcaggaggctgagacaggagaattgcttgaacccgggaagtggaggctgcagtgagccgagatcatgccattgccctctagcctgggtgatagagcgagactctgtcttaaaaaaaaaaaaaagaaaatacaaaaaagaagaattgtcacagatacttattctctataactaaaatcctatcctattctagataataacttttctcaggctttcctgagtaagatgaaaaactagtttcaaatctgaaagggaagaaaatataatctagagatccttaatataaatgacttcttctatacccagtctttcaaatcattaagtaatcttttctgaatagagggttatttccaaaaatacatatttttttgtctttatctttcatttgcccatagatgttttttgtactcctttacagaagttaacatgttcttcaacaacctgatttactttctctaacatcttgaaacaaactaaacataccatctgaaattcagaactaaagcagggacctgcttataaacactaccaagaggttatatgacatgtctcaatactcccaaggcactagtattctgactccatccacacaaaaaacaaaaattcaggaaagcaaaataaaattgaacccagacagatctaacggatgctctgaacaaattagctgcaaactgaattaatgggctatatactggttaagcaatttactttacaagcttggcaccattttcaaattgatgttttattcaatatttttaaatgatgcttaaacccattagaagcctgaagtcaatcctacttatgtcattaatctagaaatattgtaacattgaagaaaatctgacattacaacatgtaacaatcctttgttcacattctatagtaatgagaacatctcaaagagaccttgatatgctgatatagatgaaaaaaaatcctttggccgcaggcccagacttggtaatgatttctatcaggtagtaaaaatttgtttcttgtatttgttattcagcagacaagtaaataagcctttctgtctggtggcagccatcaaataagccaagatgggtacacacaagtccatccaggaggcatggaggaagaagtagtttgatgtagtgtgctttcactgatggcagtaccatcagctctcttctctccacagagatcctggccccacccagcccaataaagtgtgcagactaggccacacaaggttatgtcatatataggatttgtgtgtactgtggcggctgaaaatgcccagttcctaagggtgcaatgtatgggtagcctgtcctttatggtggtaatctgctgaagtttgctcaaagccttcggtacattgctaaggagtgagctggacaccactgtggggccgcgtcctgaattcttactgggttggtgaagattccacgtacacatttttgaggttttcctcattgatcaattccataaagctatagaagaagtcctgacacccaacagatcaccataccagtctataagcacagggtgatgcgtgggctgacatctgccagctgaaagagcaatggcttggatggtccctaaattccacaaaactatgtctggttcttgccatgcagcttggagaaggtagaatgctctccagctccaccttcaccactaatatatgtttgtataattaatatctaataaacaatttaggatagttatgtctgtttacaggtgttacttttcaaaaacagtctgcagattatttcatgaatgctttgtcaaatcatagaacttaaagtgatagtatgtcttctttctagtaagataaactttggagttacatgtcaagtgtttaaaacatgctgtgtggtgcaggaggtttaaaataaattctttaactagctctgcagatttgtctggtgcatgtgattaatcttacagctttattggggtgatggcaacactgtgctggtttactttcaagtggctgggttcagcaagtacaaacttttttagttttgctttagacatttgcagagtgggagaaggataccttaaccctatgtcgtgatcatacgtagaaaaacatggactcaaatagaatccacatttttgaatttaatctattgtttcatttgtatgactcctgcttctgagagaaaagtttccaaaaatgccatcatttctcagaataataaacgtgttgcaagaggcttttcttaggaatgaaacaaatctgggttaacctaaacaaaactgcctcagtctccacagtagcattttaagttcacataaaagttccaatgccatagctctatagaaatcaatggatagtagtcagtaaggctatttacactggcgtattgtgaaactgaatgttatataaatatgaattattaaccttaacttttacaaactactaatcaatgctaggatgggaagccagtaagctttagataaatacctttcaagtgtgagggtagaaaaagtcaactttgatcaagtttttaaaatatttatcagtaacactaatttgtgaccattatgaatcccttcagccacatcggggaaaatagttggctattcagaagcatgtacatcattcttagaccagttagccttacaaataaaaacatcttgagccaacccactctgtccacactcacaggctacagagaaaagtcataattgaagccagtataagttcctggtttccaatctaaccgtatgtgttgtgtgcagttatttttcttgtccctgctcaaactaccctaaaatccttatcattcaacaaagctggaacatcaggtatgtgccaacatttacataccaccacaatgcattgcatttgtttttatcacgtttttccatagacgaggctactgtctaccagggtaaatttgagtgtgaaggaaatgcagaaaaggaattgcacaattcttctcaattctggatttgctggctttaatttaaatactggtttctatggactaatttttctcctatcttctctatgggattcaaaaggcttggttaactgatttccagggaatattcatagaaagttcacagaagttcttgagatctaaattcctttctactaaaaaaaaaaataataataacttaaatcacacattttgactgtatatagagattgttcaactaaaggaataaatgtctattaaactaaaaacagtaacaacaacaaaaaagcaaatagacaaaagttaaaattttattttcttctcttaaagaagtcgatcctattttcttgcaaggatctaaaaatgcttttctaaatatcaattcattctcacaatataaaaatgctctagcaaatgtcacccattttcataactggacagagataaccatttccctgcccctgccttgcctagatttagaactgaagacactggctgctctcttataataaacattttatggttcttccttatacttctaattccttgtcctctcacaataatttactctgtttgataaggttttgggtcaacacccattatagcccaacatgcaaaagggcacttagtaaacgtcaatggtgaggttattacagagcaggtataacttattttcaaaaatattaaactggctgggcacactggctcacgcctgtaatcctagcactttgggacgctgagacagaaggatcgcttgaggccaggagttcaagaccagtctcggcaacacagcaagtctgtctctctgtctctattgatttattttgatggagtttcactcttgttgcccaggctggagtgcaatggtgcaatctcagctcactgtaacctccaccacccaggtacaagtgattctcttgtctcagactcccaagtagctcgaattacaggcatgtgccaccacacctggctttttttttttttttttagtagagatgcggttttactatgttaatcaggctggtcttgaacccctgatctcaggtgatacacctgtcttggcctcccaaagtgctaggattacagggtgtgtgccaccaatttggctatttatttttttaaaatttacaaaaaaaaagttaaaatggttagggacatattacattaatggaaagtacttatttccctctaggtggttaatcctagacaataagcattgtttatttaatagattctatcttaaatcaaattttattctatttaataatgtttaaaaaattatttaaagtaaaatatattaatatataattcaacattattagtacagtgataataagaaaactctcagttcattttagctgtgtatcagacacggtgctatgctgtttacatggattgtctaattttatcttcataataacgctgtgaattgcttccacatttttgctactatgaataaggcggccataccagtttttacattgacatttcctcttaaactagttgtttgcaatgttttataaaatataagtacctggtgcaagagcacaaacaattttatagtttttttttaaatatacttcaaactgacctccaaaaagactacccattttacaatacttcttgcactaactgagattactgtttcttcacaaaccaaccaaaacttcttcacagtgatgtgcacttactagcaaagctgaccattttttctgttgtctgtgcttttttataggtagaatagttggctgctctaagtcttattaattaacactattagcaatttaattattgacctatgactcttgtaacacatcagttatttgtatatttggtgtatattcatcttttatttgtacattcctttcttaatttgtttctctactcttcagaaatcttttctctttgtatcattaaacctgcatcaacttctcaacaaaaatttcaactgcttcaatagttacatatttgtccccgatctacagtagatttaaatgcagcttttccgttttttagcttacatattttgtatttcaatgcctatttctcttttattacttatcaatgtttaacaatggtacctttataagttgtttcaagcctggtaagatgaattacttaccattgctttttacttttcccttatattttggtgttcttcaatgttatttttctatgtaaactttctcttttcttttaaacttggagacacttacttactttctcacatcaccaatcatggactatttttgagtgaactatgcgtggctatgtcttgtatttcctcaggaaaacagcactactgagtgactacggtatcctatgcaaaacttcaatctttggtcatagcattacgagatcctggtttcccagccccagaaagtctctttgatatatcctatatataaacttttctaccactatactctattccaaaagattacaaatgaatcttaatatgcatccaatcaaatatataaacagactttagagaaaacactattattattttattgtagaaagccttcccacacacagaagcagaataattctcccaatgggaagtactgcaattaaaaaaaaaaaaaaaaaaaacccgggctgggcacagtggctcatacctataatcctagcactttgggaggctgaggcgggaggactgcttgaggccaagagttcaagaccaacttggccaacagagcgaaaccccattaaaaaaaagcctaagagttctatatttaaaaaaaaaaaaaaagaagaaaaaaaaataaagaagaaagaaaaaaaggctgggcgcggtggttcacgcctgtaatcccagcactttgggaggcggaggtgggtggatcacatgaggtcaggagtttgagaccagcctggccaacatggtgaaagcccatctctactaaaaatacaaaaattagctgggcatggtggtgcatgcctgtaatcccagctactcgggaggctgaggcagaattgcttgaacctgggaggtggaggttgctgagccgagattgtgccactgcactccagcctgggtgacaagagtaaaactctgcctcaaaaaaaaaaaaaaaaaaaaaaatcaaacaggtaatgaatagtgtttgtctctatagcgagtaagatttttctcttcataacaacaagctttaaagaagtttaatgacctaacacttataaacaatttaaactaatttgtagcactgataaccatcataaaaaattttaccaattaattaagatcctactaaatcatttaaatctttcacttccacaaatgtttgatttttcaaaatacgtttaaatgtttagagaacttgaatttcacagaaatgcttatatgccttagttactgaaatcttaaggttttacttaagccaataacaatgccaagaccaaagcccttgtatttatttgttcaacagctaaccgcttactaagtgctgtaagtttacaatgtactaggtgctgataataacaaaatatataagaaaccaggtttaccttcctcaagctggaagtacagtggtacagagataaacactcaatagtaatgttttacctcccccccgcccaaaaaaaggaatggttcccacaaaagaaatgtgtataatgtgggcaaaagagtaagaggaagtaggagattatgggggggtggggggagggggggcgttgaagaaaaaaatgaaaggaaggtcattccagacaaaaacaaaggaagggtgcatatcaacaaacagaattcacaccagaatttccctcagttaatgacactacgatctgctaatgtaaaataaaaacaagggccaggcatggtggctcatgcctgtaattccaacactttgggaggccaaagcaggttggggcggggcgggggatcacttgaggccaggagttcaagaccagcctcggcaacatggcaaaccctgcctctatttggcaggggatcagccaggcatggtggtgagtgccagctacttgggcgactgaggcaagacgatcacttgagcccagcaggttgaggctgtagtgagctgtggttgcaccactgcactccggcagggtgacggagctaaaccctgtctcaaaataaaataaacaccatggaatcatttaactctctctcttcccttgccctaaacatttggtcaatcaccaacacatgttttgaatcaccaccttctggtgtctgcacttgattctgccttcactagtactccaatgtcagaagagaaatcaaggtggatatggaatgtatgccccatatggaatgtatgccccaaagagtgaccctgatgacctctgcactctttgttatagacaataataaacaaaacagaggatgggaagaatcaagaaacacagcacgggcaatggcttcaagaaatgcagtaatgagaaggggagagatgaaggcccaggggacagggagttcctctgtgtagttctggacacctaaacatggatatgctacggggaagaattcagtaaaagaaaaaagatagaagatttaattaagagaagaagaaataattaaaagagtaaagtttcagaacaggatgaagaacaaaggtaaagaagtcagtcttggaaagaagcaaggacacagcttcttctgaaaaacaaaagaaacaaaaaatgagatgaatgcaaacctgaaaaagttcagcagtttgggagaggaaagttgagggagaccacactacatattttctttgtgatgtaaagtcatggggaaggtgtactgactgcaaggatgatttccactttctcctaggaagcaccacataaatactgcaaatttcaggtataagagcaacccaaaaagtaaataacattttcttaatttacaaaaactacctatttatggaacacagtttttccttttatgctcatttcactgcaatcacttctgaaacaatgccaagtgagcatccttcaaatataatacttaatatgaaatatagaattctgaagtctagaaaacaagagattacaaagaggtgggacagtaagtttcagttaactagaaaatacataaatgcgctttacctctcgtatttcgtggccagctcctctgtatgactgcaagtcctccaagatgccttctgcatcttttaatactacattcacctgattataaatttccttctcagactctgtaggctgggcatctaaacagcaggaaagcacaagaaaatttacagtgacatgaattttttaaaatacatgtgtaactctaagcaattaacaacccaaatttccaaagatgagttaattctagttaatgttaactttgaacttttaaagaaaagactaatactttttccatagtcctacatttaaatgactagtttcaagtacatagatattacagaaaacaagggaacaccaaacattattaacttagtttaagttccaaattaggacttggtatattaaaccaatctgagaattataattaaaatttttaattgtgatagttttaacaatcactttttctactacattcatcactatcactgtaaatgcatcagaaatcacagattttaatgcaaaagaaagcctactaaaacatgttgctcatgtatagtttaagacaaactatttttattttcctataaagttcattttacttttaatgactgagttttgatataaaaaagtaaaaaaactttaatagtttttaggtgctcacccccttttccaggaatcacttcgaaagtgtctcaacatatatgatattataggttaaagaagagaggatatatatatctaacaacaaacccaagagagtatcactgaactattctgctgatgaacagaaggtcaagaatcctgtgcagaggatttcaagttataaaactgctccacaattactcagctgctgaaaactagatactttaagctacactacaatactactactgaaattttgaaatactaaagaaaatctgagttcctacacacttgggagtaagagaaaaatgaaggaagaattacagttataaaaagcagaatcaaggacacaaacatatgggcattttcaccacctgtggtgttagccacaaaacatatgttaatgaatgactaaatctggatttctctctgcttgactcaagttaacagaaatcttgcttttaataatactggtcatttgtttctctaaggacaaatcttttatattttaaggaaaaaggtggactctaagaggaaatgaaggtttctttacaaatctttccaactaggccacattcagcaccacaggtaaggcataaagcacttaaaatcataaacattatgattatcatattttagagaaaaatgactggcagaattcctccatgctaaaattttctcttatgagggaaaaggaatcagtccaaatttataagatgaagtaagaacgtttttaatactatcacactggtcttttaagtttaaaaatattttaacaaacaagaaggtttttggtaaatctttgtctaccaatcatataaaattagttaactagacttttctgctccttttcacctcaccacaaatacacaatgatttctttattcctttacttagaacattgtaaagaaactttgtttacacgtgaaactgggagtaaagatccctaaaaacggtaacgttattttgtgcttggagcaagtcataattcaattctacctaataaacctgccaaatagtcaaaaatataccacattttttttaaaattcaataattacattaccaaattttaaactcaacatatgtaaaacagtactacagcaacaataaagtaacattcatatgtaaagtcaacttaagaatgtgtttacatatctgttcccttatttttcaaatttcttttcagaaatcattttttaggaggaaaatactgtgacaaaataattatacaagaggagccaattgaaaaattaaaaagactctctatccaaggctacaaaggtattatcactaggaacaaatactgatattgcaactaaatggttagctttcttatagatcaagctttgctatttagcagtaataatttactgctaaatattttacatttagccagaccatattttccaatgtaatagtcagacatacactctttttaaaaaagcacacttcataacttttatacttacatcagattcagtagagaaaaatatgttttacatgcaaaaaacgacagtcttacactttttcatatggaattgtgaaactacagacataacatcaatagtagacacgtatttagtttgaattcatgaagtgggaattcatgacaaaggacaatagtttagctattatatatcaaaggtatctgtgaagtttgaaaatgctagactatgtattttaggtgtggtgactagctgttaacataaaaatgtgacactgagacttaacatacaaacgaaacattatcaagtagacttaagtagaccttgtaagtggttaataactagtaaaggtttaataagtaccaagaaatttaaaaatagaggagaagatttaagtttccctttagggtgagaaaaacacccagcaccacaatgattaaacattttttagactgtcacaggaaagtcacatttataattttgaaagctgctgaagactgctatagaaatgaagacaaacagaaaatagcagacaagtaagcactactttactgaaagcaagtcatgcaaaagggtgaaatactaggaagggggaaaagctgtataaaacaaagctttttattttatttttttcaaaaaacggtactatataatgcaaccaagacttgtcactttgattttccatagaaaaaaatggctttactatttaaaaaaaaagtaccatttagtcagcttacaaaaggacatgcaaaattgcaaaataatgtatctactactgagggtagacatattcattactcatcaagcttagtttttaaagctgttcaagggaaattaaggcatgtttcaattgttcttattgaaggtaaattaaaaattttattaacttcacactaatttcttatagggtggagggtagaaaaagagtcaatataactgctaaaattgaagtcgttgtaatataaaaagaagcaaagattaactatgaaatgaaaaaataaaaagtcaagataaaaattataattgtgataaggggtctttctgctttaattttacattaattcacttaataaacctacgcaatctatctctgtaagttacatcaagacagagaccagaatgtacagtatgtaccactggtacatctgtaaactcagtacctagattttctgtaatacattttgaatgaatgagagggtacagagacataaataagcctctggcatgaattaaaggagactactatgctttttgatctctgaataactatgatcctatatcatttttgaaaaataaatataagaaagatgacaccagaataaagatatttcaaagtacagggcaaaaccaactgaaactatgcaagagataaatgaaaaaataagttagagtaggtcccaatatttctaaatgataagggggaaacaagtaacacaaaggacacaagaactatagaggaaatgcatgactcaatggaaaggcactataacagaatcagagaaaatatactctatttctcccttaacaaatgactacctctatttactctcctattttgatttccctggaggtaagtgagtcaagtttaaaaaatacttactgaacttctatcatttaaaaagcactatgctaagattgggaaaggacacaaaactaaatacaagtctcttttctcccaagaactagaatttagtgagctagcagttatggaagttactgaggctaaagatttgtcattagaataagctataaattaacactgttgttataaaataggaaattccaacaactagaagaggctatgcaggcccccattcagtgctttttttttttttcaaagacagtttcactctgctactcaaggtggagtgcagtagagcaaatcacagctcactgcaagggcacacatcactattcccagctaattaaaaaattttttttttcatacagatagagtcttgccatgttgcccagactggtctcaaattccttgaatcaagtgatccttttgctgtggcctcccaaagtgctggaattacagccatgagccactgcacctagctcgattgagtgctttttatatgctgtcaatagcataactgctgccaaattttatggagcaattttgggcttatattttaactgaactattattaaataaaaacaaaataaaatcttatcatataggtgtaatctgttctaaggaaaaaatccttctatcaagactaaacgtctaactgaatacagaatgacatttcatgccttaaggtctctgtccatgttgttccttctttctactgtcctttactgtattagttcaaaacattctaattcactctccaaaacccaattcaaacatcaccatcagaaagtcttccatgatgggccaggtgtggtggcccacacctgtaatcccagcactttgggaggctgaggcaggtggatcacctgaggtcaggagttttagaccagcctggccaacatggtgaaaccccatctctactaaaaataaaaaaattagctgggtgtggtgctgcatgcctgtaatcccagctactcgggaggctgaggtaggagaatcacttgaacccagaagtggagaatgcagtgagccaagatcatgccattgcactccagcttgggtgacggagtgagactccatctcaagaaaaaaaaaaaaaggtcttccatgatgattctcaatctactccctgccatttaaagttagtatcttcatgagctacacgttgaaaataaataatttaagtaaaactgagttttctggcaggtgggcacctgtaattccagctacttttgggtactgaggtgaaagggtcacttcagcctgggaggtcaaagctgcagtgagctgagatcatgccgctgcactccagcctgggcgacagagactgaccctgtctcaaaaacaaaacaaaacaaaattatgagctttcgtgtctatcctctcctactagattgagagcttccagcatgtatgggttgtatcttagttattttgcaaccccagcacctactggctggtatacaggaggcaaggcataaatgtatgttgaactgaagtgaaaaacagttacaggggtcatgagaggagtaaattaaaggaataatgatttactttaaagacaatcttaattttgtaaactacaagattccattaaattacatttcaaatgcactagagtatgtcatttgtatataatatgatacaaatagcgaggtaatctgcatgaattatttctgtagtcacccaactgcagagacatattgggtcacccaactgcagagacatattgggtcacccaactgcagagacatattgggatagacttaatcaatcagattaataaaacagtaaaactaaattactctggtgacatgaatattaaagtgcatctagaaataaacaatgtagtactaattactctagcaaaaataatgtggctttaagttattgagaattagcagataactatgttggcaattttgagtctggtataaagcagtataaaacggtttaagagaacacccatctgataggccaaggtcaccatagtagcttataaggtaagcttttacaaacgcatatttccaaaaagaagaaaaatatacagagattaaattaagataatgccaatgttagaatcaaaagacaatgtatctaaaaatctaaataagaaataacaatgggtaaactctagtttggtatacagtatgctgtcactaaatttcatttatagtataccagtaagtataaaaccagaagatctacattggctgatataggcaacaatatctgcctttacagttaacattttatatgtatttctgcattattggttattattgttgcttgcaatttttaccttttcctgtcactattattaaattataataatgtaccaggtgcagtagctcacacctgtaatcccagcactttggaaggccaaggtgggtggatcacttgagctcaggagtttgagaccagcctgggcaacagagtgaaaccccatctctaccaaaaatatgaaaaattagctgggcttggtggcatgtgcctgtagtcccagctactctggaggctgaggtgggaggatcccttgagccaggtaggcagaggttgcagtgagctaagattgcgccactgcactctagtctgggtgacagggtaagacctcatatcaaaaaaaaaaaaaaggtgtgtgtgtgtgtgtgtgtgtgtgtgtgtgtgtataaaatgatccaaacactcccacagattggaaagccaagaccaagtaatcttttaaatactacatttaaattcatgcttcccacttgaccataacataatactaggtttacaaaaagatcaagtgccaagtcttgaacaagatcttgactatcaaagtcaagattctgtaaatgtaaggaatttgagacaaagaggaaaagggagacagaatagcagaaaaagacacaagaccaagtttgaaacagatgcaaataaactaaaatacagctctaatgtaagttgcctcatctgaaagaatatcttcaagtcagcaatctgctcgacatcctcaagctgattaaaagtcatgctaaacatgcacttaacatagcactggtaaattgttgagaagggtcaagaaaactaatattcatctaatatttaacagtatttcccctaaaaacccaatttcccctgaaacccaatttcacatggacctgatattgatttactactctttactagcctgtacacagtacccaaactgtaacagatcctttatagaaatggaataaaagtagaaaataaccagagaccacaaattattctacaaaatggagatagctataaattgatgtgttcatatgaactgccatggtttagaatgattcataaaatagaatgaattacataaaattgtaaaaactaaattgaagttggaggaaaaggcagtgactttctggggtttaagtgatttatttgttttgtttttaaaatcagaaaacatcttaaattttaagtatataaaaatacattctaacacttaaaaatataagggatcacatgattaaaaacctaagaaatacctcttcaccctttcctaacaattttctattgatcagttaaaatagcatcattcacactaaaacaccaatttaataattcttctcaatttaacaaccagacaagctaaagcgatatcaacagccaaaaaaagcaaaagctttgcaacatgcaccaaggtcaatgacacttacctgccactcttagaccatattacaataggtcatgcaacataaaacaaacagaaggcaaattacttaaaggtctgtgaacccattatttttcctttcatttagagtcagaaaaaataaattcctgaaataaatacattctatttttttaacttttcaaattatctgcaaagattaaataatttaggttcacacttaccttttaatattatgcccaaattactgagctctgaatggccttcatgaacagattgatatttgaaatacttaaatatgtaccctacaataactgaaacctggtcgatttttcttgactataatataagttttccccaaatattgcttctattaataaatcttgaggtagtacttgtcctttccaacaaaattttttcataaaaatgttttcattagagaatagatcgtaaattacaaaataatctccaactaagagatatgaaatctcttataaaaactcaaagacattttatcatcacaatttaatctataaaataggacttccagttctagaaggcaccagaaatttactcaaacaattcatagctcagtcatgcaaagcagttaaaaagatggcaaagtggaaacattcatttagtgcaagacaaacgcagtctactgcaggcaaagagaaatagatataaaatcatcttctcactttcaaaatcaaggaaaaaatttggcccctgctcaaggtctgtgcatgtcaaaactttaagaagattccccatgttaaggtacctgtcaagacaagaatgagaaaagagaaaatatccctttataaaaaagaacatctgaagtttacttaaagaaaaatagtaacagggaaaatgttcattaggccatgaattcattcttcaggttacccagactgtgctctggcagacagcaaaacgggttctcaaggtgttgatatgtaggacctagaggtgaaatgtggttttcctgtacacaatggcacaactgttgctctaattcttctcaaaattctcccaagacaagtttcattaatggccttataatgaaaaattctttaagtattccaatagtgctaatattctgaaaaagaaatttctgatcaagaattatttacatgtagtactgttagtatagcactgaaacaacaatttatttcaaagccaaatattaatacatttggccatgtctcacctttgcatctcatcttaaaacagtataaaactttcttcctgcatgcggttcaataaagcatatatttctaaccaaatttggattgtcaataatttgtggaggtacggagactactgattcaaggtatgcagcacaattctgatttttaaaataaaattattacaggattataagcgaatattgtttgacatagtcactaaagcatactattagaatgttcatcataaggctacttgcttcatggactaatgaaaggacagcactggctacacactcaacatgattttagcaaatgaaaaactaaattatacatatgatggtgatgtttgcctacgattaagaaaaaatcatgcaacctttgtttgattcccatgtttaattaacaaatattctggctggccttcactgtggtgagtataattcatctttcacctttaccattatgcaccagctgtgaagggctaaagagacttactttcaaagtccaagaaaaaatgtgctgcattgtggtctatgtccctggttagcaccttaatgagattacccatgccagcaaacctaaaaataaaaatggcaacatcatttagttccagtaaaaaattttaagcagaggcctgggatttggcaaaggctggcttgctcataattatcaacaggtgcaggtttatatgcttttggcattgagaatttggaacaacaaaagcacatttggctctgagtttatagctcctgtccctcttttccacatatcaaaaaagttacataaagcaagatgggaaaaaagattagattttgacatataacttgcaatatttacattttattactatctatgttagtgttactcctttaaaatttttgaggcatatatttctcaatttaacagcaaaactagatttctcaaataagtaactatagaaaccatttttttaaataatagggatattttccttcttgcagagtcaaatcctattgggaacacaaagaagaaagtattcaaaccacatttaaccattaaagcctaaagaaagttatcaattaatgacccatctaaaaaaactttaccacacataaaatgtttttgatatcttctgtctcctaagattaatcaaacttattatttaactcttagactgaataatcaactatacacaactataccatgtatggaacttaaaagttaacacagcaaacagggagccagcaattatcacaacttagtaggtttgcggaggacaaaaagtgaaaatacggcattggcataaatgttgcccaagatttccataatgcagtgaggatgaaagtgggaaatggggtcagaaacatccaggaaaccaggttcaaacctggaaggtagagtaacaaaaggggaggcaaactatggtatcacggctacccacatcctcctccctccaactgctgtacttttcctccaattgctatgtgtttttctccaaagatcccgttgctggcaaatgtaaataaggcaaaacataaaacaatatttttattaagaaaaaagacaacttgccactcactctcattataagaagcttgaaaaaagttagcacttcccgtcacctgtggcatccccctcttccacctactctccaacatcagcatatgtttctaactgtaagcttcccatgaggaaatacaaatagctatttgctttagaggtcaaagtctgatgtacggaaacacaaatttcttataaaatgttaaaagcaatccaatttattcatatatggtaagtactgaatggttcttcccttttgaaacaatattcccccaatgggggaggtggagatctatcttcttcttatattaacatttctattacacagaatttcaatggtctgattttgtacaatactttacacaagtggattaggtgacattaagctaagagggaaatatttaatattttgacttaattactgtatacattgtaaaacatttaataataccaagcttttatattaaaggaaaagataaacatttttcctaaatcatcacacccaaataattatctcaaattggttactaaagttcttcaatagatgttggaagaaaccatttggaaatagcatatttcacagctttaatttttaaaagctttccaacatatatggaatgactgtatccaaacatatataaattttctcactaacaagaactgagaccaaatacacaaaaaattacctagtggtatcaaaattggaactacagatgaaaaatatatcatgagaaaggactataattattttcagtaggaaaaaggcagcacaccatttggttttaggagtttaatctatggaatcaaaccagaaattcgactctagcttactagctgtttgaccttaaggatggtagttaacccttttggggactcatttcttgattggtaaaacacaggtaattatagtaaatatcttaaattcctattatgagggttaaattagattaagcactgactcagtgtctggcacacagaaaacatttaataaatattggctgttgctgtaattaaaacctaaatatcacaaaataaccttttaaaagtaataatggctctatttcttttaacataaacctgagtccttatcaacacattccaatgttataaatcagaatgaagcccatatttatcaagaatattgctgaaatgtcctaaaattagttctattaacatcatcaggtatgcatggagaagagggagattaggtttccttacctttttacgtgtatgcacacagtccaaccttggggaaaattttggaactagccatgtacgtctgctccattttcctacagctcgttctgtaaacttcttcctctgtatatggttcttctttccaggcacccgaggctaatgtgatcctcccctcctcatacttgggagtatgaccactaccatcagacttggtcctgacctatttgctctcataaggattgagaatttcttgcttatttatcccatacacaaacacttagtttgaaaatggctcagttggctgggcgcagtggctcacgcttgtaatcccagcactttgggatgccaaggtgggtagatcacaaggtcaggagttcgagaccagtctggccaacacagtgaaaccccgtctctactaaaggaggcggcagttgtagggagccaagatcacgccactgcacactccagcctaggcaacagagctagactccctctcaaaaaaaaaaaaaaaaaaaaaaaaaaaaggaattggctcagtttatctaacacagtgtttctcagtctcagcactactaacattttgggctgaggagttcttttgttattggagtctgtctcacattgtaggaaatacaccaacatcttgggcttcaatccactagatactagcagctaccccccatacaagctgtgacaatcaaaaatgtctctagataccgccaaatatctcctgggggcaaaatcacccgactgagaatcactacaactgttgtccagcgcaaaaattcgctctaccacatagcacacaggacagatgctacataggcagctcatatcacaatgtctctttgaacaaaaactcatggaagttttcaaagctctaaaaacagtcccattataacattatcggttctcctatcctttataagaataaacaaaaaattaaaaccataaccctatcttgctatattttaacctggccaaaaaccaaacaaacaaacaaacaaaaaaaacccctgctgtcctctcactgtgactgttttcaactaatataacagtggttaatcatcagcttaggtgggaccagactgcctgggtctgaaacccagctgtgccacttccaaactttgtgacttcagtcaagtgttttttaacttctccattcctcagttttctcatgtgtaaaaggtgcatattaataatatccacctcagagggttcctaaaatcattaaatgggttaataataagcaccacatttagtgccatacctggcagtttatttactattactgttgcagctgtcagagcaacctaactaggggctctgttcccagcagcagaacttatggaatgtgaggcgtgggcggatgtggcagtcatacttcctgccctagaggatggcagtctatcacaagagaatgaaccaatattacagtgcaaggtctcaaagagtgtcctggagtcattaatttccttccattcattcccgagttccagctgtcacttctctcagtccagctgcttgattttcctctggttttaagataccctagtttttttaaactaataccccttttagctgttgagttggatttctgccatctaaaggagactagtaagatttctaagtttcggatgaataaatacatttgatatgaaagataccaaaggatttaagattttttttgagacggggtttcactcttgttgcccagactggagtgcaatggtacaatctcggctcactgcaaccttcgcctcccaggttcaagtgattctcctgcctcagcctcctgagtagctgggattacaggcatgcaccaccacgcccggctaattttgtatttttagtagagacagggtttctccatcttggtcaggctggtctcaaactcccaaccgcaggtgacctacccgcctcagcctcccaaagtgctaggattacaggcgtgagccaccaggcccggccggatttaagattttaaagcagacccaaaacactattgatatattttagaggtaacaaatattatcatttagaataataaactaagtcttactatctgaatttagaagggaaaagctaaagaatcttctttcaaattattttctatcgtaatccttggatttaaactaaatattgtatttactaaataagctaaaaataaatttaacacagatttaatacacagaaaccagacatggtttacctcaggagttgtcctatttctggtggaattttttttactatgagcccttacattagacatttgtttccacgttgacaacttatctggaaaggaacacgcccttcctggccggtagtctgtggaatgtatttttaagctaacaaaaggcacttaaatacattagaccattttcccataaaacatttgaaaagaagtttccttacagaataatagccaatagaaacaactataccctacaattactataatatttcctctatctttctagaagcttcctaagagatgctgttacttcacttactttttctcctcaaggtactttttaattttgtctcctcttcctagaatgctagtcccaaagattttcccatgactggcttctttccatccttcagggctcatcttaaaaggcatctctttgaagaggcctttctctgccaaccttctcaaaggagttgcaccggttgcaacttctagtgataatcttctacctacctcttcactcaacttatttcttaagcatatttatcacaatctgaatttctcttgtttagtgtcagttttcctcacatccagcttataaacgtattaaagacttgtgactggccagtgagaaggaaggggaagaaagaaaagtaacaaacacactaaccagcttcactttaaatcagggtttcttaaactcagcaatactaacatttgaactgtacaattctttgctgtaggggactgtctagtgccttgtaggttgtttagcagtattctgggcctctgcccactagataccccttatcacctctgctcccagctgtgacaaccaataacgcctccagacactgtcaaatgtcccctaggaggcaaaactgcctgttgttgaaagctgctgcttttaacatatgaccaccaacctgaagtgcagcctcagttttgctacctcactcaatctcctctcccactttcccaggtgattattccacacattaaaaaaaattcttacctttctcatgatctcttaaaaaaaaaagaagaagaaaaccacaaaaacccaacaacccatcctccattctcacttgcaggaaatgacctcactgtatctttcacacacaaaacacataagcatctatcttttctaccatcctttcttcagtaaccatacacccaccctctgtacctgttttcctgaaggacaacctttcttctggggcactacttctcctgcctgcttttgtctcctcaaggacttcatgtgccctctactacaacatcatctttcctgtcctctttatagcaagacttgtcaaatgaactgtctgtagctgtttctttccacctttcaaactccgattctttcaactcattccagtttggcttttatgcccactacaataaacctgtgcctgtcaaggtcaccaaaacttgcatttggctaaatctaaaggacaattctcacacttcaacttactgaactagcagctcttgacccagttatcacccacgccttcctgaaaacactttcttcaaaatttgacattctgaacaatacattatcttgagtttccttcctacttcagtttttctttttcagtacccttctgtttggcataaatacatttatttcttccatcttaaaacataaacagaaatgtaccttgattctatttccctcaccagctcccaccctattcccttgcttctctttgcagcaaaattccttaaaaggaataatctaacactcagcatcttttgtttctctcctttcgttctctattaaacccactgcaatgtggcttttatccccatcccacaccaccaaaactgcactgggaaggccatcaggtaacttccacgttgctaattccagtgtcaatactcagccctcacaccttaccttgcctgccaggagcatctgccctgacactcccctcatcctcctcaacacacttttatcattagcttaaagggcagcacgtctcacctcccccactgccacacctccctacttcttgctaccctcacttcctgctagggttgctggtctccctgtttccaacccagcctcctcctacaatctcttccacatataagaggcaaagcactcttttaaacatataaatcatcctttctctgctcaaagccatgcaatgactcactaacacactcaaaataaaatccaaattctttaccaggttgatatgatttgaatttgtgtctccgcccaaattcaatgacaaatcaaagacaatggggaaaatgccttgaaggcatctcagagacctttgtggcagcccctcccaccacagactcagaggccaagaggggaagaatggtttcacaggccaggcccagggcctggctgccctggggacactgctccctgcatcccagccactccagctccagccacggctaaaacagtcctagattatgtctcaagctgctgttcaggcaagtagaagccataagccttggcagctttgatgggtgttaggcctgcaggtgtgcagacagcaagaattgttgaggcttgggagtctctgcctagatttcagaggatgtatggacatgcctggatgttcaggcagaaggtacactgcaggggcagagccctcatggagaacctctactaggacagtgcactggggaaatgtagggttggagtcctcactgaggcactgcctaacatagctgcgagaagggggccaccatgctccagaccccggaatggcagatccaccaacagcttgcaccatgcacctggaaaagccacactcaatgccagcccttgagagcagccatgggaggtaagccctgcagagcaagaggggcagagctgcaaaaggcattaggagcccaccccttacatcagtgtggcctggatatgagacacggagtcaaaggagattattttggagctttaagattgaacaactgccctgctaggtttcagatgtgtatcaggcttaaagcccctttgttttggcctattctgcccttttggaaggggagtatttaaacaatgcctgtaccctcattgtatcttggaagtaactaacttcattttgattttaaagactcataggtggaagggacttgtctcatctcaggtgagactttggactgtggacttctgagttaatgctgaaatgagttaagacttgagggactgctgagaagggctgattatattttgcaatgtgagaaggtcatgagatttgggaggggccaggaacagaatgatatggtttgaatttgtgtccctgcccaaatttcatgagtgttggagaaggagcctgctgggaggagactggatcatgggagtggacttcccccttgctgctgttgtgatagtgagttctcatgagatctggttcttttaaagggtggggcacttccccatctctcttcctcctgctctggccatgtaagacgtgccaccttcctcttcgccttccgccattcaaggtttcctgagaccttcccagccatgcttcctgtacagcttgcagaaccatgagtcaatcaaacctcttttctttagaaattacccagtctcaggtagttcttcatagcaatgtgagaacagactaaaacagaggtcccacaaaatcttacacaatctgctccgacacactctggcctcatctttctttactctccactgcacacatgcgcatctaaccacaaaagcctgcttgcagtttctgctgctcagtaaggcctcacctcttcagagagaatccttgagctacctacccacctataaatgccccttccatcctcctctctatccccttcccaaactgatggttcgtaccatctaacacacattcctgttactcttatctatttactctgtcttcctctgagtaggcaggggttttgttttgtacactactctatcctgagcacttagaacaatgcctgggatgtagttggtattcattaagtatttgctgaaaaaatacatgattaaaaatagagaggccaggtacagtggttcatgcctgtaatcccagcactttgggaggccgaggtgggcggatcacctgaagtcaggagtttgagaccagcctggccaacatggtgaaaccccatctctactaaaaatacaaaaattagctgggcagggtggcaggcgcctgtaatcacagctactcaggaggctgaggcaggagaactgcttgaagtaggaggcagaggttgcagtgagccaagatcgcaccactgcactccatgggcaacagagctagactttgtctcaaaataaaaataaaaataaaatcctaggacccttaagaattatactacatccactctgcctgtgctctctaaatggtacaacaaagcctagatgacagcatatctgtttacagcatggtgtactcaatattctaagcccaccattgagccctattcctcagaaaaaaaatattcgtttcaataaattactgctcactgataatgcacctagtcaatcaagaactctaatggaaatgtgtaaggagattaacgctgttttcatgctgctaacacaatatccactctgcagctcatggatcacaaagtaattctggctcttaagtcttattatttaagaaatacatttcttaaagctaaacctgtcatagatatggattcttctgatggatctgagaaagtaaattgaaagccttctggaaaggattcaccattctggataccgttaagaacctttgtgattcatgggaaggggtcaaacatcaataggagtttgaaagaagttgattctaactctcacagatgactgtgaggggggttcaagacttcagtggagaaatggcagatgtggtggaaataccaagagaactagagtagaagttcatcttagaagggcctttaagatgtgactgaatagctgcaatcttatgataaaaacttgagtggatgaggagttgcttcttatggataatcaaagaaaatggtttctttcctttttttttttttcttttgagacagagtttccaccttgtcatcttggctcactgcaacctcagctctcgggttcaagcaattctcgtgcctcaacctactgagtagctgagactacaggcacaagccatcacagccagctgattttttgtattttagtagagatagggtttcaccataatgcccaggctggtctcaaactcctgagctcaggcaatccacccacctcggactcccaaagtgctaggattacaggcgcgagccattactcccagccgaaaatggtttcttgagatgaaatctactctggtgaagatgttgtttagactgttaaaatgagtatcacatgaacacagctgataagcactggcaaggtctgaaagtactgcttccaattttgaaagttatactgtgggtgaaatgttacccaacagtatcatatgctacagagaaatctttcatggaagtgtcaactgatgtggcaaacttcatttttgtcttattttaagaaattgcacagccacccaaccttcagcaactactaccttgatcagtctgaagccattaacatccaggcaagaccctccactagcaaaaaggttaagacctgctaaatgaaggctcagataagtgtcagcatttttatcaataaagtatttttaaattaaggtatatacactgttttttagacataaatcgtatcaataatctcagtaacccttctgaaaatattcaaggcaccaccctcatcaaatattgcccgaagtctgcttattgaacggcttctaagaaactgtaccatcacttgaaagcaggccaggcgtggtggctcacatctgtaatcccagcactttgggaggccaaggtggggagattacttgaggtcaggagtttgagaccagcctggccaacatggcaaaactccgcctctactaaaaatacaaaaattagccaggcgtggtggcacgtacctgtagtcccaactactcaggaggctgtggcatgagaattttttgaacacgggaggcggaggctgcagtgagtcaagattgcaccactgcactctacactctgcaacagagtgagaatgtcccaaaaaagataaaatttaaaaaaaaaaagaaaaaataaaagaagaaaagagaagagaagagaaagcaagcaatgtcaccaaaaggaaatgaaaaggtgggaagaagaaaaacaaagggatctttcaagtcctgtcataatttcttccagcagtaagacagctagggttccaagctctagcttcttgtggaactcccagcagcagtgcattatctggcccccttcaaaggtctgagactccaggcctatggggttcttccttcaggctcctaaattctcccaaatccatctcttctcttttgttccctcagccctaaaagtaattgctgcttcttgtggtttctattaatatctaagttacctcagcaatctcttttggctcaggtttccaacacttgtgaactaaatacatatattaaaatccctcgttttctttctgctttcctggttggaatttgactgatatcggagaagttctagagaacagcttaatccttaaccttactaacactatctaactcactgctatcaagtactagtttagctattaataaagtgatgctttgattctccatcttttgtgaaatgtaaaggaagagacagagagattagtacaacaggattcaggtattcctggatgccagtgttaatatcaacatagtagtactaaaatctccccatgaagccctagcaaatgttaagatccatatattttaattttagctactaaattacatgcagttaactcacttgacttaaagaaatgtgatataacaatggattaaaaattgggagacttgatttctagtcctgactctatcataaaatgcgtgcctttatacaagtcagtttacttgttagactaaatctcttactgagcttctggctattattctacatccattccactccatcttgcctaatgctgacatctagtggatggatacacttagacttcatattatagaatgaaaaatcttatttcacctatttctgttgggccatgtgcaatggatataataaattaggagaccaatactgttccttacatggaagtgaaacacaataaaatagtattagatcagattgtcatggtatctttgaatctgattcaaagattactggcactcttccatgattccagccattaaatgttaaaaaaacctctattacaggaggtaggaaaaggaagagtttaaccaccaatgcaaattactgtcagagccacatatttagaccatgaaagcacagaaacacatcctgctacaatggtttgcatcaagtacagacaaagagtatgagaagggctagtacaaaggctcaaggcaagtaatacagaagtttctggaatggaatatgatggaaatatgcaaaacaactcaaaatgacctattttataaggacttactatgaaagtttctcttgaaaatacgttatcattagacaaatatagtattctgaattcattttgcaaacattattttaaaatctatgaatgcaaaatgaattttatttcatgtcaacaactcaaaagaaaagcctggtcacacaagtccactgtcacatttaattaccaaaattgtcagaattttttttttttgtggagtagcattctgcttttaactatggctttctttatatatcatgctgtaaaataaatatatgccaatagtttcaatgattacttctggaaatattttattttagaaaagtttcatttcattatatatttcaaaattacactaggctgatgtaaaacgcaagagcaatgggcacaattgggtggaagtgtaaactactatgagaagtttgggaaattagtctgacattccttctgaagttcatgtgcaatattcacataatgaactataatactgtgcaaacaaattaactccagctacatacgataaagatgaataagagaactataatgctatcggcaaactgtacacaatataataccattaaatcaaacatcatattaaagatactggttatttatacagggggagacaatcataggattgggcaactttaaaaacctgagaattattctagttcctcaattagcggcggatttgtgggagttttatttttaggcttcacaatttacaaatgaagtatgcacactcttgtatgaatcagtaattttgaatgtttaaaaatgtaaagccattgatgctcagagaacacgtatgtctcactgaaagatgcccaacaaaaaagcttagaatggaattcaggtacctacctctttctaatacacatgctacaacgcatggatgatcagttttttaaaatgtatcattatataagcctcagatacttctatatatttagcttttacagtatcagtggtggtagtcgttttaaatcaaacaacatttacttagcacctgtctgccaatggctatgatgaatactgaatatctggtgctgaggaattcacagacaagtggaagagaccagacaagcaagtgtgggtatgctttcataaagaaaaaagcaaagggcattctgaacacacagaaaaaagaatacctaacccagtcttggtaaagtaaataaaagcttcccagaagggctgattcttaattctttcttgtttgctatttatttaaattaggaagtaattccaacataaagtataaaaaaaaatactattcacagtctgtcacccagattaaaactataacaatttagcaatagttgcttcagatgggctacttttttgtgtgtgcagttgacctcccaacctctttcaatcaactttcctcccctcctctctcactgaagataattagtatctttttaaaaaaattattagatagagatgggttctcgctatgttgtccaggctggacttgaactcctggcctcaaccgatccttccacctctgacttcaagtgctgagattataggcatgagccatcacactaggcctttttttttttttccagcatggtttccttgccaaacatattttaagattttttactccaaaggtatatattcatcataaacaatacagtattgttctgcttttcaatttgcatacgtgatatactgtgcattctttgaaaactggattttctcactcaatagtttttaaaaattattaatatgttcattgtagctattacatactattggattattcaaagaaaccagtttattcattcctctactgattgacaatgagattattttccacttttaaatattaacagttatgctttacacctccatacacacactacatatacttaagctcatgtacaagagtcctataggacagctgtctgaaaatgaaaaggcaactgtaactttaatacatggtgctaaattgctctcccaagtgcttccatcaattctgttccacaggtacaaagatttcctatttcctgtcctccaaaacctcaagtttaatttttagagtctgaaatgtctcactgatgtttaaatttgtattttcttatcagtaaaaatgtgcacctctttgtattatatgtttatgggccatctgtgaagtgtatatgcatttcctttgtcacctatggtccttatttttctgttgtttcgcagccccactcctacctttctgcactgctggggctgagaatgcaaatgacatttcccagacatctttgccagctgggttcctgttaggaggaactggagggtgagaagacaggaggaagagagaagttactgattagaacaggctagcagttgttgtaggagcagtgtgaatagtatccaataccctaattagggacaggtgcagcctgtaggttccagcctagtggtggcagcagcttgtctctggtaaaagcagcatcataatttcttattttatttttgctactctgttctctcccttgttccttttgctcttccagcttttctagtatctttgtaaccaatcttctatattaaattgtttgaaatatccagagtggtaagttttcctaacttaacttcaactgtcataccactcttttttcaaactgagtgttagaaatatatatatatatatatttttttaattaatttatttttttgagacagggtcttgctctttttcgcccaggctggagtgtagtggtgtgctcacggctcactgcgacctcaaccaccctggctcaatcgatcctcccacctctgcctcctgagtagctgggactacatgcccgtgtcatcatgctagtgtgtgtcggcggggttggggtgggggtgggggtgggggtgggggcaggggcagggggaatactgttgttgtttgtttttttttgtagagacaggatctcatcgtgttgcccagactggtctcaaattcatggccttaagcaatcctcccccaccctggcctcctaaagtgctgggattacaggcatgagccatcatacctggcagctttagaaattctggataccacccttttaatgcttatatacaaggcagatactttcttctaggatctaacatatcttaactttgtttatggtgttgtttgtcataacagtccagtttttcatttttcttcatggtctgtgcttactgtttaaataataattcttcaaaattgccttattcttgcccttttattcactcatgtgattgtcaaattctacaaaaaaattctgatgggattttgatttgattttgcattaaatatataattgccatctctataatttcaatcattttgtcatttaatctatgaatatgacagattacataaattcattttctgttgctaaaccattcttgcattcctgagatcaagtctgcttggttggttatttatttatgtatttatttatttatgaataaatgaatgagggtgaatgaataaatttgaaacacggtcttgctctgttgcccaggctggtcttgaactcctaggctcaaggaaacctcctacctcagcctcccaaggtgctacaactacaattacaggcgtgagccactgcacctggtttatttgatcatttaaaaatatatattcctagatttggttttgctaacatttcaccttggattattttgtaagactgacctgtaatttttttctctgttcctgtctggttttgctgtcaagcctatttttatacatagatttttctattatttagaaccatttataaacaatacaatgtgtcaattactcagtgagttttataggaaagttcttccaaacatctaagaagtctacatctgtttcatttttgaaactccagcctaacagacattctgtcacacagccagtactcaataaatatttgtcaaattaataaatgaacaattcaagtaaaaagcagcttatttatccaaaaagagaatacctaaactaagggcatcccataaaaagagtaggtttaggtcaaattaaacaaagtgcaacttaataaattagggactaagtttatggaataatcccttagtcttacctacgaagggataattcaaatacaagatctataaacatcaagaaaatcaaggacaaggttaacaggcaaaggtttactgctaaaacattaaagctggcctggacagcaatgatattttcccacaatactctttaccacctctgagctaatcttcaatggtgtttcccatgttcttatgcattatcgcaatgagagttcaaatccttaaaaatcctgatgaccaacagtcatcttcagaagtagcaattttagttttctgctttttgcacagagaataactaagggctacagagacattctcatccattacttataaacatgccacccacctccccagagtgagagtctctggtgcctcttccagtcaccaaacagcagcaaaaaagcaaggaacttaaggacctactgccaagtaaacaggccttgtggcagtgaaaggataaactgtccatcattctttcttctcctcggagatttcacaggaaaaggagaaagcgcaggaaacaggaggcctacaattgaaaggaaatctgccagaatttggcatatagaagtaaagtgtcattcctagtcacctcactatgactgaaatggataagagattcttaaaaattgttctgctttctctcataatttgagttaaaagataaggtattctctgaagttaagtatcccttaatttctggggttgactaggggctcttctcaacactatagtcactgtgaagagtgaaagacaacaggcagaatggctttatatcccattaccaataaataagagaatctcagaccaggaagggaccattcacggtcaaatggaagactcacccttgactatttaaccttagtatgaatctattctacaacatatccacaccaagtagccatctcaccactgcttaaatactctacatgacttaaattttagactttggtcaatttttagaaaaatttgtagaaacttaagacaatgactgaataagcacaattaagacatgaattctaccctcgaaaaccatacaatccttgtattaaactgaaattcacccatttgttaacatctcctccttggtttaaattctctttggcctcctagaaataaactaaacacaatccctgtgctacttaacaaaccattaaatatatgaagtatcttaaaacaacagtcaaatgaggtcaaaataaagttacccatcagattatgtatgttcacatttgcaaaggtacaaacaagacatctcctatctagtaatgccagccaagaatttagcttctgagtagagtttataagtgattttctaggtagggagaggcatggtgggcggctaatgcctataatcccagcagtttgggaggtggaggtgggaggattgcttgagcccaggagttcgagaccagcctgggcaacatagcgaaactccatctaaatttttattttttgagacagagtttcactcttgtcacccaggctggagtgcagtggagcaatcttggctcactgcaatctctgcctcctgggttcaagtgattctcctgcctcagcctcccaagtagctggaattacaggcatttgccaatacgcccggctgatttttgtatttttagtagagatggggtttcgccatgttggccaggctggtcttgagctcctgaccaggtgatccacccgcctcggcctctcaaggtgctggaattacaggcgtgagccactgtgcctggccccaatctaaaaattttttttaagtttttttgtttttttttttaaaggaatactcatcacaaagaccttgttaaacattataggctaaagaaccaagggcagtggaaacttttttccctgtgatcttaacttctgtttccaaagcaccctgcagagggctttgcatgacgttagtgctaatgttaagttaataaatgaacgtttattgtggcacatacaattcatccaaaaacaattaagaaaaatttcaagtgttcctaaaagaaattagtactaaaacttctaagttagaaaaaaaatttcactggaaaaaacttttttaagaaaagcagtaagtatgttatggatggttggatgcagaagctaaaagtaaaataaatttaaaaaagaaaaatgtatgcttattaggaaaagaagacggatgttaagaaatgttcttaaatagttttcaacagtttgtcaggtctttctgtttgagccttgtacactaacggaatttaatacaagtgaaattacaaaaggcacaaatgttttcctggttcttgaacttaatttaactgaactaaaattaaaatcattctcttaaatctatctcctccaggcttatcataaccaaacagaatacaaaaacatatttttcttctcttggtaatagaattttaaagatatgtacttgaataattttctacattaataaatcagtatctcttacagtgctaaaaagagtccagcagaggtcattcatttacattctgatgttgccaaggaggtggtaattataactgaatatatacagttttactttgcctttctttttttttttggagtctcactctgtcgcccaggctggggagtgcagtggcaggatctcggctcactgcaacctctgcctcccaagtcaagtgattctcgtgcctcaccctcccaagtagctgggattacaggcatgtgccaccaggcccggctaatttttgtatttttagtagagacggggttttgccatgttgaccaggctgatctcgaactcctgacacctcaggtgatctacctgcctcagcctccaaagtactgggatttacaggcatgaaccactgcacctggcctttcattatatcattttttaaaatacaattttacttcagaaagaagtaaaattttacagcagaaagagatccccctcagtaaatttaaaaagcaggtcccataattattttcaaatgacaaatgacaaggccaggtatctttgtaaataattttgcaaaagctggtttgttttattttaaaggctgatttatataaaataggaagaaacctatgttttcttaatactgtggaataagctaattgtaaatgaaatgttgagatcattattaggaccaaatgcagtatgtgcatatcatataaatttttttaactaagtatgccattaattattacaccttctagtttcacaaagcatataaaaaggaaatgtttatataaagcaaagttcaaatcactaaaccactttgaatttttactgtcaacctacataacagagagaggatcacaaagaaaagatgtttatttcagaacagagcattgcaataggaatatgcataacatagtaaactatgccatacatattcagggaggtaaaggaagacaaaggtttttaaaggagaaacaagggttatataatagttttgaaataaatatccttagctacaaagatcaataacaagggtgacaccagttggaggctgaacaggcagttgctgggcagatgtccttgcagaagtactattttgtgtaaggtggtgatggcctttgtgtaaggatatggtctttgtagtctctttcattatcaggcatacaagtgtgagaacactctcttcacagccttccctggctctgtacacagcttccctgggtttccttaacattagtaactccattttgattctgaagactttcactaccacatgtctaaaggtgctaaaaaaacggagaaaggggatgacaaaggatagaaaatctgagcccagactaaagggtttgtgaaatgacttgaacgagctcaactccctaattttatgaaagaagggaaataaagactagagcaacctggtgacttggacaaagcagcaaatgagtaaaaaaaaaatgtggggcttaatccactgactctggcagtgcagcttttgagaacctctttaaaacatggcatcagggccagatgacatcaaaagaattaagtaccaccacaacaaaggaaacaaaaacgaaagtcacgttcccaactatgtcccctttgaaatgattgttaatgctgtttttgctgttaatcaaactttaacagacctgacattcaatttgtagtcagtgtcagctgctgggcaaacactgggattcggggacatcattctaggctctttctagatcaggctgaaacttaccaccgtacagcttatactactgatggaactgcaaaacagctggtgactttctgcaagtctctacctttttcttgttttcaaaacacaattatcagagcactactattcgtatctttcctatggcaatgatggcgtttctcttcttaaaattttggtgtctcatactgatatttgggttttgggagggtgttttttttgagacaatgtcctgctctactgcctaggctggagtgcagtgacacgatctaagctcatggcaacctccgcctcccaggctcaagcggttctcgtgcttcagcctcctgggtagctgggattacaggtgcgcacaaccatgcccggcttgtatttttagtagagatgggatttcgccatgtgggccaggctggtcttgaactcctggcctcaagtgatccacccacctcggccacccaaagtgctggaattacaggcgtgtgccaccacgcgcccagccctgatacttgttttttacatatttacttcatgttctttgaaggcaggcactcgccaaggcttaacacttattttctactctctttctccacaaaatttgggactacagcctgggactacaggcacacgccaccacacctggctaattttttgtatttctagtagagatggggtttctgttattatggaccagcaaatagaagcttcttcaaagctatttcacaaacttctagcctacatcattaggataccttttttttttgagagacagagtatctagctctgttgcccaggctggagtgcagtggtgagatctttgctcactgcaaccttccaggttcaagtgattctcatgcctcagcctcccgagtagctgggataacaggcaggtgctaccatgcctggctgatttttgtattttgagtaaagacggggtttcaccatgttggccaggctggtctcaaactcctgacctcaatccacctgccttggcctcccgaagtgcgaggattacaggcatgagccaccgtgcccggcctgtaactacttaagattagtcatatagaatgtgaaaaactacgcttactgaagtatgatggagaaaggtctagctgaattttcactaactgaggttcttaatatggggagtccatagagaattcagggatctgtgaatatggatgggaaccttttcactaacctctatacaaaaattaacaattccttcaatcaagaatattagtaacaaactacagtagtattagaaaacctatgaatttgtcattaatagaaaccatgggtatttttgtattacaatttttgcacacaacatctatttaaaattatgatatatagtatatttactcctaatgcttattctctaacatgagaaacacacatattaatgtaagaagcacacatattaatgtaagaagcacacatattacttatcacaaatttgtatttagtatttgttaatggcttttcaatgtaacgtttccttcttaatcctatgtagtttacttcatacaatcatgaatcattattagaatcattattctgaggcaggattcataggcttcataagattgccaaagaggtccttggcacaaaaaatactcgttaagaacctctgaactgtaaaatacagagtaagcaaggtgataacaattctgaaggactgtcatagaagtaactgttgtaccagctctaataaaatgatgggctggatttttgtttttgtttttattgtttttgttttttgacacagagtctcactctgttgcccaggctggagtgcatggcgtgatcttggctcactgcaacctccacctcctgggttcaagcaattctcccgcctcagccacccaagtagctgggactacaggcacacgccaccacacctgcctaattttttgtatttctagtagagatggggtttcaccatgttggccaggctggtcttgaactcctgacctcaggtgatccacccacctcggcctcccaaagtgctgagatgacaggcatgagccactgcgcccacccttgtttttgtttttagagacagggtcttgttctatcacccaggttaaagtgcagtgatgcaatcttggctcactgcggcctggacatcccaggctcaggtaagccaccacgaccggcctgatgagctagttttgaaaaaatatactctgtttataactaagaagaacacggaaagggattttaagctagtcattttcacttaagaacacaaaatctgcctgtaaaaaaaattacattttgaatacttaataacttgttataattaaaacaactgcaggattacaaatgtttcagtactcaggaccctttaacagtaactaccttttatggtaacgattctttgtttctaaaaaatttttttttaaaaaaaggaccaaaaccagtaacagatagaattcttaagattatgtgtaaagtgtcttcccttctgttttcaatgaaaaaaaatatatatgtacatatatatactttaaactactaaaattatggcttagaactttcttgatcaactatactggtgacagctaaaatgacttaattcaaaggaaaacacatacctctcctaaagaaagaaagctgttaaaaaaagttctaattaatttacattttccccaccaggtcctattctaagccaaaaactaaacaatcaatatttcctaacaacatttttagcaactcaatattgtgtatagaacatttcccttaaattatatatagttaatataagtttttattgaaatcataacttttcatttatatttgaataatcatttcccccaaagacatatttaccttcagccagtgctggtgattctgtccttgtccttctatctgtttaaggaaagaaaaaaaggaagaaagtctaaaacattattatactttaaaacaagtttttattacagttaactttaaagtttacgaatgccatcatgcacgtgcacattttatacatacacacatatatttatttatttccttggattaactcaaccaccatttatggaggacctatttagagtaaggcatcatattaagccctggaaacaacaataggtaagacaacccagttgtcaccgtcaacatactcagagagtaaaaagtgtacgaagacaagtacacaattctcatcatagcttatgaagcaaagggtaagaaaaggaaagttagttattcctctttagtcttacagcaggggcctaaaactatgaaaagaggcatatttatatttcttatcacagtttaagttcattcagtttcaatgtattaataatcagttttactcaaggtattaaaatccttattccgtgaccataacctattatttgccagggacacatttggcaaaattcaagtgaaccacaaagccctctctaggattggttttattatttcactcattcattcattcatttctgcagaaagagggtctcgctattttgctcaggctggtctccaattcctggtgctcaagtgagcttcctgctttggcctcccatagtgctgggattacaggcatcagccaccatgccgggcttggttttactatttcaaacacacaattttaggtaaaatggaatcttcagaatgagtataactttgcaaataaggttataagaagcaaataaagacattaaccccttggagaagaaggtatggatcactctatcaggaaaaagcctcatgttttcactctagctgaggtacctcctcctgattgtactatctgtggttcactttctgctctggggctttgcaataggagacgtctacaggaattcttcagctatccagagatataaacaaacctgaaaatttgaaggtgttaacaccatgggcaacccttgaccaacgagagatgggatctagcaaataaataccaccttcttcccagcaaaaggcatatctttattgctttctcacagggcttcctcaggatcaagccccagttgctcacagaagtgagcagctcaataacgcacccttggattggcgttccctctttcctagttcacttgttccagtccttcaacttctgtttcttgctaacaggtgtgcaaatgaattacctgtaagaaagcacccatctcagtttctgcttttggagtgaaactaggtcaagacacttgatttccacaataccataatcccttttcatcctacctcactggatgctccttcttaatttcgactacgctttcttgcacaccccatattccacccaaactctcactacctaaaatccttgtgcctactatctcctactaactcaaggcagaagattctgttgcctgagcattatcagatctactactacttcatattgaagagactagaacagaggttgcaaaaatgcatatggagttggctggctgaggccaccttaggtaaatgttaaccaggcaaataaacgtgtgtgtttatctaaatggtgccactgctatcaacatgccatgctaaaaatacaggtgatacagagctcaatatccatgtaaaacagattttagacattagcaactaatgaaataagtcagacactcaacaggccaaatgaaacagtctaagggctatacgtgcatgaaccaccagtttgcaacttctgctccagaacctcacgttgtctacaatttattttttaattaatttatttatttgagacagagtctcactctgtcacccaggctggattgattgattgattgattgattgattgattttgagatggagtctcactctgtcacccaggctggagtgcagtggcgctacctcagctcactgcaagctctgcctcccaggttcacgcgattttcctgtctcagcctcccaagcggctaggactacaggcgcctgccaccattccccgctaattttttgtattcttagtagagacggggtttcaccatgttagccaggatggtctccatctcccgatgtcgtgatctgcccaccttggcttcccaaagtgctgggattacaatctttcacttttctctatgagttagttcacaaatgggagtcacgttcaaagcctaactgttctagcttttctcaaaagcttgccttggatcaatattactagaagtgaaatgaataaacactttttttgctttttctgccgaagataaaacttccttccctaaggcccactgcaggctcccagaaataaacaaaacaagtggcttgactgaccacttttataaaccacagcagaaaaaccagtgccactttgcataaaatcatgggggaaaattcaattatttattcttaataaatcaagacacaataaaacacttgtaactgtattcacccttagaaatcaaatatcaggtcataaatagtaaatattaattaatatttaaattggatcatccaggcacctaaaatctacaaacctagagattcctcaagttaagtgttaaaatttacttgcctccatacaaacaaatggaagaacattccatgctcatggataggggaaaaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatgctactggtaccaaaacagagatatagaccaatggaacagaacagagtcctcagaaataatagcacacatctacaactatctgatctttcacaaacctgacaaaaacaagaaatggggaaaggattccctattcaacaaatggtgctgggaaaactggctagccatatgtagaaagctgaaactggatcccttccttacaccttatacaaaaattaattcaagatggattaaagacttacatgttagccctaaaaccataaaaaccctagaagaaaacctacgcaataccattcaggacataggcatgggcaaggacttcatgtctaaaacaccaaaagcaatggcaacaaaagacaaaattgacaaatgagatctaattaaactaaagagcttctgcacagcaaaagaaactaccatcagagtgaacaggcaacctacaaaatgggagaaaatttttgcaatctactcatctgacaaagggctaatatccagaatctacaaagaattcaaacacatttacaagaaaaaaacaaacaaccccatcaacaagtgggcgaaggatacgaacagacactttcaaaagaagacatttatgcagccaagagacaagaaaaaatgctcatcatcactggccatcagagaaatgcaaatcaaaaccacaatgagataccatctcacaccagttagaatggcaatcattaaaaagtcaggaaacgacaggtgctggagaggatgtggagaaacaggaacacttttacactgttggtgggactgtaaactagttcaaccattgtggaagacagtgtggcgattcctcagggatctagaactagaaataccatttgacccagccatcccattactgggtatatacccaaaggattacaaatcatgctgctataaagacacatgcacacgtatgtttattgtggcactattcacaatagcaaagacttggaaccaacccaaatgtccaacgatagacttgattaagaaaatgtggcacatatacaccatggaatactatgcagccataaaaaatgatgagtttaggtcctttgtagggacatggatgaagctggaaatcatcattctcagcaacctatcgcagaacaaaaaaccaaacactgcatgttctcactcataggtgggaactgaacaatgacaacacttggacacaggaaggggaacatcatacaccggtgcctgttatggggtggggggaggtggggatagcattaggagatatacttaatgtaaatgacgagttaatgggtgcagcacaccaacatggcacatgtatatgtatgtaacaaacctgcacattgtgcacatgtaccctagaacttaaagtataatttaaaaaactatatatatatgaaaaaaaaaatttgctggcctccagcaagacatgagttattacttcagaccattctgtcaaccatgtttacagctctgtagtatttcaaatgatggtacctatgatggcctggtgcagtggctcacgcctgtaagcccagccctttgagaggccaaggtgggtggatcacctaaggtcaggagtttgagaccaccctggccaacatggcgaaaccccatctctactaaaaatacaaaaatcaaccaggcatggtggtgcatgcctgtaatctcagctactcgggaagctgaggcacaagaattgcctgaacctgggaggcagagattgcactgagctgaaatcacaccattacactccagcctaggtgacagagtaagactctgttcaaaaaataaataagtaagtaaatggtgttgaaataactccatggaaaactaagacagacccttctcaaactatacattacacatggatttgagtttaatttctcaaaactaaatctcagaaaatagaacaaagaatcttacttatctttggaggaataatatgctaaaatataaagcactataaaaaatttaaaatggaaagatgaatcaatcatgtaaaaattaaagataagggataccaaaatgtcttaaaatagttcatgggagtgtatataaatcacatgaagacaacagaaaaaaataaacgataatttgtaacagggaggcaaaacaataaattatgaaaaaaatgtatactccctaataataaaaagcaaatatggtaaaatggtttagagaactggttctgaaatcaggcttgggttgcatttccaattatttaaattattaagttatttgagcatctttatttgtaaaatgcagattttcacttatttaaattaggttatctatgcatccttttcctttgtaaaagagcaaaaataaactcaaagtgtgtagattaatggaaatgctagttttgctgaacatggtcattaccttttgtatttaatatttaatattaaaattacaataatatgtatctctctactgacactaaatctcaagtacagtactcttaagaaaaccatgtctaacagcaccagaactcaaacacctgaggattcctctatgtcatcctacaccatgcttactaccacaaaatagtttgatcagaagaaagcacaatggttacattaagagcctccctccttgatatacctagaactacattttctatataaaaacaaataccaaggcatatatgatacatataaatcttaatactgcgcaaatattaatactaaatattaatacaatatcaatacattctttttttataaagattttaaaaaaatgtttttaaataaaatagagatggagtcttgctatgttgaccaggctggtcttgaactcctagcctaaagcaatccccccatctcagcctagcaaagtgctgggatcacaggcatgagccaccatgcctgaccaagaaattcttaatctctattgtaaacccatgctccagaagatttgaaataccaacatttctaattatctctaaagtttttttttaattacctccaggaaaaagtaaattgcagtaacagttgcctaggtaatgccaggctttcagaacatgacttgatttttgtagagtctaaaaagtttttacaatcttaattttcccctttattataagggtaaaacatgctcactacacaaaatacataaagaaagtggaaagaaacaagtaccactacctataatcccacaaccaaagctttaacaatttattctcttctaatttcttttatgtatatttttatacaatttaacaccctttctttgtatttgtactgctttttatcattcacatcatgagcaatattttcacatcattaaaaactctgccaaaataccacttttagtctttacataccaactcatcatatggttgtaccacattttttcaagcattttctcactgctggacattcaggtttttctaaccttttgctcttttaaacgatgctatatgcccaagacttccataagcacataaagactttgtgagattagaagaagttatcccagtctaatataaaaacgtttatgaactattattttattacacaacctcaacaactacacaatatagctctgcctgggttggggtttaagaaccccagcaagcaaacaccctggctgtgcatacacatgcccctgcacacaagggtcacgctcttgcctactgacaaacataatccctgaacattaaggcacataaacatacctaagccagtgccaggcacccttgccccaaatttctcaaatgagactaccagatcagtttctgtcagactggagtggtgggcaagttagcgaaagacatcacctcaggggatgcctggagtctggagctcagtctggacaagaccatgctgtaaccacctgcatggacagagtgtcctcacaggagctctccagagtcttcgcatgccataggtgctagtatgggtttatgtaccaggcaacttactgtaacctggaactcctggctccaagatgtggccagaaggcccagaatcccttcactcacccacggtcttctcaaagtgacatgtctatctcatgtctgatacacccacaggtgtggcaccccttgtgcagagggccatgtgaacaccttgaataattatcttagctatgaacatatatctttgttgaaataacttaaaaatgtttaggatacatcaaggtctttatacctagtgccaaattgctgtccaaagatacattttaattaacactaccatcagaatgatgcactggccaacttcacagcatccttgacaagtggtgccttctttcactttttttttttttttttttttttttttaaagagacaagggccaggtgcaatggttcctgcctataattccaacgcttcaggaagctgaggtgggaggatcacttaagaccaggagtttgagaacagacaagacaacatagcaagaccatatacacacaaaaattaaaatgaacagccaggtctagtaacatacaactgtcgtctcagctacatgtgtggctgagacaagaggatggcttaagcgcaagagttcaaggccacagtgggctatgagtgccactgcactccaacatgggcaacagagcaagaccctaattctaaaaacaaacaagagaaacacggtctcgctctgtcgcccaggctggaatgcagttgtacaatcatagctcactgtaaccttgaactcctggcctcaaggtgttctccctccttggcctccaaaagcgctggaattataggcatgagccaccttgcccggcctctctcccattgttttgttaactactgaggccagctattttttcctccacaattgtgtaacttagtccttcccattttctatcaaggccttatgtatttttaaggaaataactatcaaatctgaacttccttgatcagatactcaatataaatgtataaagtgaggtacagtcttttaaaattgtccctttctactcagctgcctttttctaagtacttcctatgttttagacactgtactgcatgatatatttcacataagcctgtgaacctaataggttaaaattaaacccttttcattgatgagcaatcagaggctttaaaaggttaagtagtttgtccaaggtcatgactagagggtaaggaattgggaaaaggagcggaagggacagaaatgaggaagggaacagagggagaaaattacttttcaggaaacaatcttgttcaatatttattataatattcctttctgtagatgtgatttcttgtaaaacaaatactacttttccactaacttcttttattgtaaaattaaaaatgattctttaaaaaaataacccacggccggacgcggtggctcacacctgtaatcccagcactttgcgaggccaaggtgggcgaatcacgaggtcaggggttcaagaccagcctgaccaacatggtgaaaccctgtccctcctaaaaatacaaaaattagcccgactgtggtggtgtgcaaaaaaaaaacaaaaataaaaacaaacaaaacctacaacagcaataatgctgttttcaattatgaaaaacctgaggcaagggctaaattaaaaggctcaccaggctttgaggacattatacagaaccttcttacttctggatctcctggttactgtcaatatcttgccctgattactgaccatctacaatgggacttttctgatacttcaactcagctaagttttggaacatacagccatggagagactgtaaaatgcatttttgatggcaggtgctgcaatcgtgctaacctaaagattccacaggtttaagatacgttctgtgaaaacaagtaagtaccttattttgcagctctataagctcaaactctgtaaaattaaatgctagttaaaagaaagaatttttagtgttcatttaatctaccccacatgttcaaacccccttataacatttacacacataattttaaaggaatggtaaatacaaacagaggtaataacataaggcaaataaagctttacagtttatatatatacacgctccaaatttaccccaggttcgatttcataaaagatcaattggttgaatttatacatcctgctaaatatatatatatatgctccaaaattatctgaagttgcaaactgcactagcactgaaatgaccattccttccagcttctcacctgcttcaccactcccccagtaccactctctccacctctagtccaatgctgcagttatctgaaattacaaagtttttttttttttttaattatgaccaagtttggcttacctgagaagtgcaaggttggttcagaatacctactgttttcaccaccctaacagattaaaagaaaaaagccatataattacctcaaaagatgcacagatgcactctggggttgggggaaggggaggactgggaacagagaaggtgcatttcaatgaaaacaaagacttgggttttttaaatttgcctttatttttatttttttattttagagacagggtcttattaggatgcccaggctggggctttcttttcttgcaagtcatttttttttcaaacaattctatatgataatcaacaggatgaactaatgaaggcatattaaagagtggttcaggtaaaatgattcagtgaattcctaatctgtgtgtcatgtttacggtgacagaaaacaagtgtgttctctactgctgttaaagttatctctactgctgataaatttaaatacaaagcgcaaaagtgaatcctacaatgcaataccatgactttcaggaatctgcttcactttttttttttttttttttgagacggagactgctctgtcacccaggctggagtgcagtggcatgatctaggctcactgcaagctccgcctcctgggatcacatcattctccggcctcagcctcccacgtagctgggactacaggcgccggccaccacgcccggctaattttttgtatttttagtagagacagggtttcaccgtgttagccaggatggtcttgaacttctgacctcatgatccacctgcctcagcctcccaaagtgctgggattacaggcgtgagccacccctggaatctgctccactttcaaaatcatgcctacataagcagaagctcttgagataaaccttgtctttccccacagtgttgtaattacagtaaaagcttttccataataatcagaactagaagttgttcaattaattgcaattattgatagaaacatttaaaatacatacacgtgcattcattagctaatccttttttaagaaaaccaaagcacattcttcaatgacaagccattgctagagtattttccagccactatgatccaatgtttttgtagaaattaccagaggagaaaaatatttaatttttaaaaacttacaaagtggaaattccaattcttcacagactacgtgtgaacagttcatggaccagtgctggtttgcaaagtgcgctttgagtagcactagtataaataaagcacgggctctggagccaaactgtgagcctcacccttggacaagtttctctctctctagtggggataatattaatacctaccacctaattgggttattatgaagattaaataagaatatgtctagcatttaaaactgtccctgccagataaggactctataaatgaaagttgatgttattatcattattactattgtatagaccataaccataaatacactttttctaaaatgtctagtttttgtcttttttaaatgtaatgagaaatgaaggtactgaaaatacagaattctttatagttttatccttttctccaattttttatatcctgatccatgaccaatcatatcacttcttttaaagtgagtcactagtcactgcatacctgttattcactaaatgtacaggctgcagagcagtagctgtcctgtgttacttccctgtccccagtgacaaatccatgagatactttttttttaaatgggcaactgaaggagaggatttgccaacaaagacgaaagtgaagcaaagaaacaaaagcgataatgctggaaataaaattctaatggaatataaatggagttacaaaagaaagagttgactgtgagaatggtgacaccgctgccaacagggagactaaatatgcagccagaggaaccttctgaaggtaaactgatcaacataagagagtggttatggtgaaaaggatgacaatgtctcagaggaagtcatgccagcaaaaatccttcatattaaaggaacttttacatatacttcttgatattcacaatgtaatggataaaatgtttgaagctgattcaaatttagaagtattaacaacttgtccaaggcctagaaatgatgctcactccacactgtacaacagggaagaagaaaccaggcacagttctaattactcttgaaaagatttttacaaataaataaaacactttagttttcaaggtttaaattacactgtactaagtaaatactagttttactgttttatccatttccctatacattttgcaacaatgagagttatgttttgacgaaaatttctaaaaatcatgaacaacataatttctaagattgctttgcaaaatttaagtctgcacaagtatttttacattccacagcacaaaatgagaactgcctgtatacacaactttcacaacctaagaaggaaagcaactgaatctaaaaacaggcaaaagatttcaacagataattcaccaaagttaaatggactgcaaataagcacttgaaaagatgctcaacaccatcgggcactagagaaatacaaactgaaaacataccagatggctaaaaaaatactgtaaatgaccataccaagggctggtgagaatacagtgcaaatgaattcctatacacttgtgcaaagccactttaaaaagttaaatatacaccttcaatatgacacagtcattccatctacgtattcatccaagaaaaatgaaagcattatgttcatacaaagaatcatacactaatgttcatagcactttacttgtagtagtctcaaactgcaagcaacccaaatgttcatcaacaaatgaatggacagactgtggtatttccatatgctagaatactattcagcaataaaagaaacaagctactcacacatccaacaataaatataaatctcaaaatcactatgctgagttgaagaagccagatataaaagaatatatattgtatgagtcctcatatataagattctaggagttaagtctgggcaacacagtgagaccctgtttctaaaaaaattaattaataaaaaagtaagattctaggaaacgcaaactaatataaggacagaaagggcacaggtggttgactggcgtctaggggcaggtagggtggatagatttgaagcaggcaggaaaaaactttgaaggtgattatgttcattatcttgattgtggtgatggtttcataggtgattaactatgttgaagctccacaaactgtatgcttaataaaacttttaaaaatggtccatggaccatctgcatctgccaaaaatgtggattctcaggcttgccacaacccactaaattttgtgggtcaagcctgagaaattgcattttccaagatccacattactctaaggtatgtatttactctgtaatctagaggatctaatgcctagagtctccagaagaactatctcactcaagctttagaacttaagacatcttattacattcgtatttatattttaactttgaaatctgatatataggtgatctctgaaatagttcaataaaagaaaaaagcccatagagacaaaagttttaaagctaaaaataagctttatgatttcaatttaaaatcatatcttgtcccaattccatttcacaaatgggaaagttgagacccagaaaggttaaatttgggcagagtcagtaataaaatgcaaatcttctattctactttcttctgaaatgaaattctatccaactttcttctacaaaggcttctattcctctgctttcaatttctcctaaattcatatttattctttgtcatttccgtagctcagatttttatgctctcactcctaactactgcaataatctcctaaatggttaacctacttctgtagttctctccccactttatttctatcacacaaatacctgagtacctaatattagtcaagcactataagagacactaattttatctcatcactgctctattaaaaaaaaaaaacttctaatagctcccaatactcttcaggatacattctcaaactggcacacttaggaatgaatatccattctgatttcaggctactcctaataaacatgctactagagcagagccccctaacagcctatgcccattccagtactgaaatctgtttcctcctaaaaaggcattcctttcttccttctaaaaagattcttatccttaaagggccaatttaaagctattcctgctttcaacaggcttttcccgaggactccagcccacatcaatccctataattctaaagcattttcatccaatagtacactgctactcattggctgcagatgttagttgtataactgagggaagataaaatttgtttctcaagtcttttgtaccctatttaatatgcagtgcttaagtattttacaacgaagggaaacagcatagcatatataggtagaaaagttttagtctagaggctttgaaaccagtcaaataccagtttgaatcctagttctgacaattaccataactcaggatcacacagctagtaagcattagtttcctcatttgtcaaatggagttaacagaccttacagcactgttgcaagcattaaataagattcaatgagaatgcatgtttactgcttaggaaaaatcacaaacattcacttagttgtagctattattagcaacacagatcaaatatccaccatgtggcagatattgtactaggttctagaaacaccaaactgtttaagatttaagcgctgatcttaaagaagtttatgtattaatacataccaataccattcatccatccaagttagaaaacaccagtcatcattcttacctgtactgtaagacctgaaaaacctgaccattctatttcctgaagacctctactcacacaaccactgaactagcagttcaagccaggactcctactatagcctatttgggtctcactactccacctctaatcttttctaactaattctccataatgttattagaataatccttctaatgcagaaacctgatcacatatctacacatcatccttcccattagtctatatctgtaattgtaatggcataggacacaaagatctcaggctgactcaattcttaaaaaaaaatttccaagatttctcttaaatatcttggccaggtgcagtggctcaaggcctgtaatcccagcactttgggaggccaaggcgggcggatcatgaggtcaggagttcgagatcagcctgaccaacatggtgaaaccccatctctactaaaaatacaaaaattcgccgggcatggtggcgcgtgcctgtaaccccagctactcaggaggctgagacaggagaattgcttgaacctgggaagcagaggttgcagtgagccgagatcgcaccactgcactccagcctgggtgacagagcgagacaccatctcaaaaaagaaaaaaagtcatttttatgtattgttaaagcagctttttaagaaatttaattatttctttaaatacttcagttgtagttttattagaaaatccaccctactactgcagtgatttaataacaaaaaaattggaaaaagaaaatccaccctaactcgtattacttcattttcacgtgtttacgagtgaccactggccagtacgtactatcaataatggctgcccaccacaattatccatggaccaccaccaccctgtttttaactatgcatgccacagagctaccacagcagattcttattcaccaagcctacggtacaccatggtatttgtttttttaagaagccacacaatgtttctaatatatagccaggattgcccaatcccagattgagaaactttacatagaaaagtgaccagatatgataatattgctttgtctatctaaagcaggggtctgcaaaccacccacagaccatgcctaatcccatggctttttgttctacccgcacactagaatgctttttacgttttctaagggttgaaaaaagaaaacaacaatctttatcctgaaagtagttaatgacttcctgtggaaataatacttgcatatataaaaagtaacgaattcataataattctgtcaacaccaaagtattgttacagactacaattacaacagaaatttagagaacaggacagtgtgagataaaggtatattccatgtgtgagttaaaaatcttctctgtaggcctcacagcacatcatatcactcatcaaaacgctggaccctttcccatgactcaaagtggctaccacaggctgttcattgttatcatactctgctctgcactaagcacaatgcctgaaacatcacagtctccaaagtatagatgctgaatgagtgaataagcaaacatcataaataatataagtacattagaataaatgcaacccgtctaaagttaaggttccaaaaggctgtcattctgctaaaatgatttgtttggggaaaagagagataaggagaggtcaatgtatcgttagcagaaaactggtaaaatttagaaaaatatgtaatttctcctattaaaaattaaataaagagacttcaaatgaaatactctaaggtgtgtccaccaccgttttacagatagtttttaaattattttattttacttatttttttaagagatgggtttttgccacgttggccaggcttgtctcgaactcctggcctccagtgattggcctcggccttccaaagtgctgggattgtgggtgtgagccaccgtgcccacccagcctacagatagatatagtttttctggactgataaaactcagttgcaccaataggcatagataaccactttggagtgatattatatatctgatatgtggtaacatatattaccgcatgtcttggtagcaatagaacaatagattttaagactatgaaaaatacttttgtcacatagtgttaaaaacgtcctcaaaactcaacaaagatcagttacagactcccaataggccagacattctatgtatggcaaagtacaaaatgctgtgtaaaaacaagatctgccctcataaagctcatagtctatgagatgacatgtaaacaaattactacaatacagtacaattaaataaaatgctatgctggagttctgtggttaaactgctatgggaaaacagatgagggagtaatttcattatgtctagaggagaatgtcagagaaagctagagaagtgagatgtctgggtgccttacatacttaaaaaaacaccagtactactaacaacttccaaagacatttttatatgcttcaaattaagtcaaataacttaattttaagatttatgttagcatatacactaaactggaaaaggaaaatcttctcctatacaaagcattttaattactacctatgattgttaacaatggggtaacataataaaataatactaaaatccttaagaaaaaggctttattaaactgagactgagacaactccaagaattcagaagaacaccgggtaagatttttcagtcctaataaatacaaaactgcactgatttattcaataatttctatcccgtttgctatccatgtttgaaccttaatctgtttgcccttctgttatttctatttattggatagcttatataattccaaatttggactatcaagtctgaacttacaaaccaaatcaggggaaaacactttcaaaaaaaaaaaaaaaagtactattctaaaaattactctttcatggtcagagtatatatttatgtagtaaacctttatctttaaaacatgtaagtccagcctgttaaatgtcctatgaagtggttctttcttgtctatcttctcctcttttaaaaactaccttacatgtcttatgagcttttctcccaagtgctcattagtagccacatggaatctaatgggttcaacagacaagacatcaatacacacaactataaatatatcatatcagataggttcatttctcaaaagagctcataattcttcagtagaagaactttatttttcctaacatttagaagtttcatagagataattaagtagaaatcattcagtattttcagattttggctatttctttatttcctagacttaaacatcttagtttaaatgatttttaacagatagtcacccacaaacagaatgagtgccataactgtacttcaactgctatgtaacagacttccatatcatcagtaatttttaactaggtatttcagactggaaaagataaataaaatttgattttaaaataaattctgaaaccattaactcataacatcctggatgttttaccttctgctaccctactcattcactaatttaataccttacaaaaacctgtacagtttagaaattcccctatcccctttcatttgatttccaccaaatgtaggagcacttacgtattctagatttcactgtttagtttactatttgcagtatctaggaattcattttatctacagagatagatttcttgaacaagagacaaaattttagtcatttgggaagtagaccttgcttccttgaattaacagaaaaaatattaaagtgcaagaataggaaaaaaattgtaagtactaaaaccacaaaaatggagaaaaatgttgatctatgctaaatgatgtacaagaaaatactgatcaccgaagtgaacagatcatcaatatttattttagccatttctttcagccttcttcctaatgtaccttttactcagacataagtcttatctattaaaaaataaaagttaaattgtatgtagccatcatttgtcacctttgcagtccatattggagaatgactgttaatgcttcttttcagaatttgagattcataacaatttacttatctttcctctacactattaaaaactgaaactaaaacaggaaggttttcttcttccctaacttcttgataataactaatagctattattcagatatacattaacagccattatttgagtgtatgtcctctcctatgttaggctactcagtgaaaagttttgggcaaccagatattcacatggtttcaaagtatcaccaaaccgagaccttttacaaggtctcactctctcgcctagactggagtgcagcggcacgatcacagttcacagcagccttaatctcccaggatcacaccaccacactcaactaatttttgtattttttttggagagacaaggtttcagcatgttgcccaggctggttgacaccatcttaattgaaggataaaatttagtatcaccaaaaatgtgacagacattatatgcctgatgatgtaatgcaatgggatgtattcaacattaccctatgtaataaacttgtcaggtatatataaactgattctatttatcaagaaacaaagcagacaaatcttgattatgaaatattttctatcagacagcttgcctggatgaaaaggagcaggtgtgaagattaaaaaaagaagaggagttcagttttggacatgttaaatttgagaggcttatgagccaccaatctgaagatgttgagaaggcaatgatggatacagaagtatggagttcagggaagaggtcagatcacaaatactttatctacaccccaggactttgtatccaaagaccaaggacacttgaaatggttcacagtggcaacagtaagagaccagtggccacactgcactaaccacactgttatggtaacataatctgggcagtattttcttgctgctcatctgcctctggttattgctcattttgtgaagctgggttcccactctctccatcaattctgtaacctacctgtcatcatcccaacaaattccttttatgtccaaattacctagtcagtttctgctatttgcaaccaaggacccgttaatgaattatgaagaatattccagtctcgaatagaaaactgtaatttccttcccaatttaaagccattcctacaaacaagcagaatttatggtacaaatataactctaaagtataaatacacataataaagatattcaaaaattaaagacggtacagatcagttttttgagatatttaagaggtcccaggataattaaaaagaaaactttgtttcaaaacaaaatttgaacattattataaaagtagaacacccagaaaaaaatggcaaaacaccaagatcatttaaaaaatatctaataaaggccgggcgcggtggctcacgcctgtaatcccagcactttgggaggccgaggcgggcggatcacgaggtcaggagatcgagaccagcctggctaacatggtgaactcctgtctcaactaaaaatacaaaaaattagctgggtatggtggcaggtgcctgtagtcccagctactcgggaggctgaggcaggagaatggcatgaacctgggaggcggagtttgcagtgagccgagatcgcaccactgcactccagcctgggcgacagagtgagactccgtctccaaaaaaaaaacaaaaaaagatgctttactttgttttatacattccaaactactcctactaagaatagtaatgaaaaaattctccggccgggcgcggtggctcactcctgtaatcccagcactttggaaggcaggggtgggcggatcacctgaggtcgggagctctagaccagcctgaccatcaggggaaaccccgtctctactaaaaaaaaaaaaaaaaagaatacaaaattagccaggcatggtggcacatgcctgtagtcccagctacttgggaggctgaggcagaagaatcgcttgaacctgggaggcagaggttgtggtgagccgatatcgcgccattgcactctagcctgggcaacaagagcaaaactcttaaaaagaaaaaaatctccacctaagtctacatttatgtatgtatgtatgtttgagatagagtttcgctcttgtcacccaggctggagtgcaatggtacaatctcggctcactgcaacctctgcctcccaggttcaagcgattctcgttcctcagcctcccaagtagctgggattacaggcgctcgccaccacacccagctaatttttgtatttttagtagagacggagtttcactatgttggcctggctggtctcaaactcctggcctcaggtgatccacccacctaagcgtcccaaagtgctgggattacaggtgtgagtcactgcacccggccaagtcaacctttagtctcttatttcatacacttccctcacacgtcagtaaaactacttttcattctttctaaaaacttttcacatttcaaatcaaaagtataattgttggctatactaaagattaaacatttcttacatccttgatagtacaccatttatgtactaaactccctacctccgtttagtatttttaaggaatacattttgaagaagtaaaacatgaaaaagagtaaaaacacttaatagggaatatttgctttaaggaggaaaaaagtacgaacatatgtgaatatctagtatgtaccatgcattctgctatagatgataattttttttttaaaacactgcaaaaccggtgatgttacctttttacaaaaagtaaatgaggaaaatgaatttcaaacactggtttaggccagctgcagtagctcatgcctgtatccccaacactttgcaaggctgaggcaggagaactgcctgagcctagaaatttgagaccagcctgggcaatcagtgagattctatctccaccccaaaaaaaaaaaaaaaaaattagccaggtgtggttgtacatgtctgctgtcccagctactcatgaggctgagatgggaggactgcttgagaccaggtcaagactgcagtgagctatgatcatgccaccacactgcagcccaagcgacagagtgagacctgcctccaaaaaaaaaaaaaaaaccggggggggggggggtggcggggggggtgttacttacctcacatcagtgctaataagaggtcagtgtcaataaggggtagatctgtttccagaacagatctgcctatcccaaagttgatgccactttattcacaacaaaatgcctccatgagcacattcttcgaaaaattcattctcattaatttttttattagaaaaacaattgtaaccattatactgaacaagccgaacccgtgggatgtaactataaaaaacaattttttgtccacgactagcctttaaagttactctgtagccatagttaatgtccctgaactttcatttaggctaatgatcatgactttggtcactcccaagttataaaaacaatctgacttttaaaactgaaagatccagctgggcatagtggctcccacctgtaatcccaacaatctgggaggctgagacagaggatcacttaatcccaggagctggagaccagcctgggcaacatagggagaacccgtctctacaaaaaaatttaaaaaaataaaaaaacttagccagatgtggtggtgcatacctatagtcccagttacttaggaggctgacgtgggaggatcactcaggccttggaagtcgaggctgcagtgactgaaagatctttagtataatcgtcaaatttttctcatttaaagttagtttctctgctttcccagctcagccctacacagtacaagagcactacacgcttttactccactcctttccaccttgctaaccttgggtggggcaattatgtgctatcagagagcttagacactttcatgactcaaaaaatgtttaggccgggagcgatggctcatagctgtaatcccagcactttgggaggccgaggaagatggatcacgtgaggtcaggagttctagaccagcctggccaacatggtgaaaccccgcctctactaaaaatacaaaaattagccgggcatggtggtgtgtacctgtagtctcagccactcaggaggctgaggcacgagaattgcttgaaccagggaggttgcagtgagccaaggtcatgccactgcagtccagcctgggtgacagagcgagactccgtcttaaaaaataataataataatgatgacaataaagtttaaagctgattctgttcaggaatgctttcaggggttccttgaaagttgggagctctcactccaattcctgtaatgcatctcctctgggaatccagcctccatcctgtcccccttatacctactcttttgggttttccctcatgtggtctcacttctctcaggtggccctcatgtgatctatgggaaacacagatctcttagtccaaaaaactttgggagcactggcagtccatctacacagcaaccttgctttcttttgctgtgctgccaaagcagatagtctctctttcacccctgaaaatttccaggtatgagttagacagacatcaatttactgtgtccaccaaattgcaggagttacacattaagttccccaagtggtcactataaagcccttctatctttactggagggggagtactccccatccctccaacaaagacagaggaaagaggttaggaaagactcctagaataccaacaactgggttaaaaaacgtttccaatttctaacaacacgtgtcaaaaactcttttccaacttccaactttctgaatgaaaccttttacaacaacagatggatacatattagaagtcacgatccattttctggctctcttttgaacacccacatggtgtccttaaaactcactttagaaatatgcatctgttgacttagggtcaaactcagaatacaagagttccacccattttagcaccttatttcgtattctgtattttctaaattttccatgaaaagcaggaataaaataaaaatccacaaccttaccactcagccacggttaacactgtccctttatgccacttaaaaatgtaagtttatattttttaaaaccttgtacaataacacttcatttatataatttcattaagcaatccagtttatcacccaatttaaacacattacctttttcaagcatcaaatttccactgaactagtgtgctgctctttctaaaatgtgtctcactgtgccactctgaagtccaaaccctttaatggctccctaccagagattaaacttcagtcttttaaatagtgtaatctacagtctcctagagctgttacatctctaaatatgattttgaaccatgtatgcaccatataaaatcatactacaagaaaaatgcaggtgtcagaggagttcctaataatgggatgtgatctacactagcggagagaaacatttcagaatttgcgaattcaaccttgtaacccctcaatgaagctggatcctgagatattttcaacaggaactgggaccaaattctgaaatgcaaaagaacaaaggtggctatttctttattagcatgataaaactaagcttgcagtggggatcagtcctcacatgattgcaaataaaattctgtatcactacacatatatctactggctccacactcattatcaccaactgccaaaaagttaatctaatactcaagagcagatttataaaaactttaaatgcctaaaactggatttgggaattaattttgttgtaagttctacacataatgtgctgcattcatagagcacacatttaaaaaattgtcttagagtcaagtggagtggctcatgcctgtaatcccagcactttgggaggccgaggtgggcagatcacttgagatcaggagtttgagaccaggctagccaacatggtaaaaccctgtctctactaaaaatacacacacaaaaaaaaatagccaagtatggtggtgcgtgcctgtaatcccagctacttgggaggctgaggcaggagaatcgcttgaacccaggaggcgaaggttgcaatgagccgagattgcgccactgcactccagcctgggcgacagtgagactctgtctccacaagaaaaaaaaagttttaaagtcatcttttaccagatgaagtgagaagtaaattccatttaaacatgctaccaagaaaaatgcactcatagttcttagctcaaagaggcttcggtctgctaagaagtttaagtcagtaaaaatgcacaaaattacaaaagtccctgcagaaagaaaaataatcagttctctcttaaagctgacaataaatgtattcactcaaaaaagtacacaagaacaatgagcgtaggcaaatacggatatgtctctatgaataaatgtggagagtatgtgtgtgtagtcatctaacatatatatatgcataaagatggctggaaagatggtcaccaaaacagcgactacctaggtggtgatttttgcttttttcttttactactctatattgtttcaatttttttataaatatgagcatgtatgtttacaagaattttcattattaaaatacagtatgaaagctacagtaatcaagccatgtggtactagcagaatgatagatcaatgaaacagaaataaaagtctatagaaaaacccaaacatttgtggtcaactgattaccaacaaagacatcaaggcaattcagtagaggaaaggatagtcttttcaaaaatggttcggagactaccggaaatccacaggcaaaaagttgaacttagtaacttacaccataaagttaacaaaaatggatcatagacctaaatgcaaggaccaaaactagaaaccttttagaagaaaacacaagagtaaatctcataatctttggtgaggcaaagatttcttagatatgacacacactgcaccattcttaacagcaaaaaaaaaaaaaagttaaactagactctaccaagtgaaaatgcttacacctcaaaagacaccgttaacagccaagtgtggtggcacacgtctgtagcatcagttattaaggaggcagaggcaggaggattacttgagccctgagtttgagtctagcctgggcaacacagcaagacctcgactctgaaccccatctcttaagaaaaaaaaaaaaaaaacaccattaagaaaaggacaagtcacagattgagagaaaatatttgcacataatgtatctgacaaaggacctggatacaaaatatataaagaactcttacaactctgtaagaagacaacccaattaaaaatgggcaaaaagacctgacagacatttcaccgaaacagatggaaaaaatggcttggtgctgcatgcctgtagtcccagccctttgggaggctgaagcaggaggatcgcttgagcccaggagttctaggctgcagtaaggtgtgattatgccactatactccagcctgagtgacaaagtaaaatcctttctttaaaaaaaaaaaagaaaaaagaaaagaaaagaagaaaatggcttgaaaagatgctcaacatcattagtgattagggaaactcaaaccacaatgtatactacctcccacccagtagaataattataatcaaaaagataatgacaagtgttgggaagattcagagaaactgaaatcctcatacactactggtaggacataaaatagcactgacagtctggttttggcagtttctttaaaaattatataagttttccatatgacccaataattctattcctaggcatctatgcaaaagaaaacatatgtccacacatatctgcatacaaatgttcacagcagcattatttataacagccaaaaactgtgaaccatccaaacacccatcaactggtaatgaataaacaaaatgtggcatatccacagaatggaatattactcaacaatagaaaggaacaaattactgatacactcaacatgcatgaaccacaaattaaatgaaagaagccagacataaaagatactgtatgttccattcataagaaatgtccaggaaagaataatcaagcaaaagtgagagagtgagggagagagtgtgagaaggaaagagggagacacggggagaagagagagagggagagggagagggagaggaagggaagggcagtgtgtaagagctagaagataggaaagtggatgcctggggcagggggtagtatggaagatgaatacgatttcaagggatcttactgggttaacagacaacatcctagactatggtaatggttgcaaagctgaataaactaactaataatcagtgaattgtgcatttgaaatagatgaattttatagtgtataaagtatacctcaataaaattgtttttaaaaagatggtgaaaaaaacttagtatataattatgtttactgaaggaatgattaggtttttctagatgccaaagccaaaaaccagtgagaaaacaaaacattttaaatgaaaacataaattaaaatagcataccaaaatggcgtacataccacttatccccattatataagtgattttcactttctgccttttagtggaatacttctaagggtcatgattaggtacaggaatttgctacaagactttatgtgcaatgtaacctggatacagtggctaaaactacctggaataaattgttttagggtaccggtacctgtttagccctactttatgacttaggacagtttctataatacagttaaccagttatgcgtttaaaaacaaaactggcgaggtgcggtggctcatgcgtgcaatcccagcactttgggaggctaaggcaggtagatcacaaggtcaggagttcgagaccagcctgaccaacatggtgaaaccccatctctactaaaaatacaaaaattcgccgggcgtggtggcgcatgcctgtaatcccagctactcaggaagctgaggcaggagaatcacttgaacccgggaggcggagcttgcagtgagccgagatcgcaccactgcactccagcctgagtgacagagcgagactctgtctcaaaaaaaacaaacaaacaaataaaactgttcattcatctcttacttatgagaccctaacaagatcctagaagggatctgagagacaaggggcagtaaaagaatttcacaaaaagttccacttgcagacctcaactaggaagaattgtgaagtgcttatatatatatatattttaattatttaaatccataggctaccctcctacccaaactaggcatactgaaaatggtttaaaaactttagttttaataaaacactgtttttaaaagttgcttataaggcatgaacaatgaaaatctgctaaaactaagttcttaaaagacacacatttaaaatgttaatagactactaagaggtcagtgccacataccaaagactgaacactagccagttgtcaccatcgcacataccataatggaactttggcaacccatttcaaaaggttgccaaccaggctacatattttgactactgcttcaacatactgttctataaataaaaagacagagctttagtttaactatattcacattttaatacaggcagttccaaatatcaaaaagactttccaaaatgcttcatccctcattttcagggatccacctgcttttacccactggcaactgagaactagctccacagcaagaagactgttttaagtttccaagtctctaaattcacgtatgctttaacccaaatgaatggaataaatgaagttgacttctccatacttttgaaaaaaactcggtaaatatatttactaaataccaggacacatttagtatctaacatttaaataaaaataaattcaaatataacaaataatattcagcaagttagctttcaaaataacatttttacaagacttgtttacagaaaataactggaagggaggataatttataagatgctaataaataaaatggagccctactcccctaaaaaaaaaaagaaagaaagaaaaattgtgaatttgaacattcccttcactaactatgctagcctctcatttacctaaatctacacatataaagggaaagaagcctccctgaaaatgttcttaatttacatcatttagtttgttggaatttgccagaatttaaagtagagaactgtggtttgatataaagaaagcaaactaatctcacaccttgcatcccaagatggttttctcatatttcacttaaattcaatgtccttgaaattcttaaaaccctgtaatctctttcaaattgaaagacgtatgaacatgtcagtcattactttttgagtaaatgttattaaagtgaccaactcatctttgagaaaattaatctcaaatttccaccaaggtcattacatataactttgccctcaaaaacagattaaaaaatgaacagcaccaataataataatatgtgtcgtgttcttatcacatgccaggaactttttttttgagacagagtctccctctgtcacccaggctagaatgcagtggcatgatcttggctcactgcaacctccacctcccagattccagtgattcttttgcctcagcctcccaagtagctgggattacaggcgtgcaccaccacacccagctaatctttgtattttaagtagagacgaggtttcaccatgtcaaccaggctggtcacaaactcctggcctcaagtgatttgtccacctcagcctcccaaattgctgggattgcaggcgtgagtcagtatgcctggcacttctttaaatgtcagatttaatgaggtataatttatatatgttaggaaataattcttcataagtatcttcttttttttttttttttttgagatggagtttcactctggttgcccaggctggagtgcagtggcgcaatctcggctcaccgcaacctccacctcccaggttcaagcgattctcctgcctcagcctcctgagtagctgggattacaggtgctcaccacttcgcccagctaattttttgcattttcagtagagacagggtttcaccatgttgggtaggctgcttcataggtatctcttttgcatacagtacaagcagaggtaccagctgccctttgctctagagagtatcttttcaagaatgtttgtagagtgaacagtcttgagaaataaagatagtatctccttctggagcaaaggacaagcatgcttactgtctgttcagtataataaatataatgtattcctccagagcaaagggcaggcgtgcttattgctcattagaaaagatctgggttcccttaactcagggcttctctccagtaagaaagcccactgggtgtacaagtactacctggtcctcttcacatcatcctgtagactgaggctcagaaaaccagtgcaaatgctgatactctggctactactattatagagaataataatctgcccttgatctttaacacaggagtttcatgtcttctaccagattccatgaaaatatggcaggataatttattagcttgcaagtaggataaaatctcagaccatcatggttcttgacagttctggggaaagaggatgggatgctgacatagccataactctctaagggaaaggataaaggccctgcagactgagttctgggacaagggaagataccctggaatctgagagtgatcctagtggtggatgggaagaaggtgggaataaagactcccccacctgtttacctgttaatgaacagggtggaattaatgtttagaaactgagcagtgagaagtgaggctgaaattagccacccaaatggtgggttggtagttgttcactatcctctgggctggtggaaggaggggagtatcataacaataagggcaacaagccccatggtcccacatgaaaggctgtggctgtgactgctgagccaaggaatcccctaaactaaaagaaatggtgtaagtaatgatgaccttgctgccaactacagagcttcaagtagaccagaaacattaaactgcgagagaatgacccaaagtgaatataaagccttgattaccagcaccaagttgctctctccccctccacactccctgatccctctctgctcctacccccaaactcttctgctttaatgagcaagatggttaggaatggggctgaggtctccctgatccccaagatggactgaaggccagacatactaggaggtttgcccagagaagttcagggagagactcaaaattttatggttctcttggaaataggcacccaggtaaccattctatctagtcctgtcaggcagacacccagattaagctaatagggtctggacagggtttacaggggttaggaaaataaatgtgacttatgggtgggatgttttggaccaattcaatgtgcttattgttgcctctacatcataatgtatagtaagaactgataagccgggtgcggtggctcgcgcacctgtgatcccagcactttgggaggccgaggcgggctgatcacttgaggtcagaagttctgagacctgaccaacctgatgaaaccctgtctctagtgaaaatataaaattagctgggcatggtggcacgcatctgtagtcccagctactcaggaggctgaggtaggagaatcacttgaacccaggaggcggaggttgtagtgagccaagattgcgtcattgcactccggcctgggtgacagggtgacagagtaagactctgtcacacacacaaaaaaaaaaagaagaagaagaagaagaagaagaacctgatgtgttttgtgcttgtacttaaaagactcacttaagagctagtgagggtttttccaatcagaaagggctgtatgtataaaagtgtactagtacctttggggccccacaaccttaaggatcactttgagccataaagtctcatgatttcactgattagaggatttgacaaaaggaggcagcctccacctacaggtgccccttggggttttgaacgctttacctccctgacacagcaatcaagtttacgccttctgaaaagcagctattagcttgcttctggattccagtggaaattgaatgcctaactcatggaggcctcacgagtctccagcctgatgttcctatttcgaggtgggtcagcttacactcaatgactaacaatgcggtaaatcaatggaaaatgcttatgtgaaacacacctggcttagtcttagccccaagaaggatctcaactttacatgaaaaagggctggcataaatcttaaattataatatcacattatgatatgtcatatcatgataggtcataatatatattatgatacattatgtcatattgcggcaggccaggtctcactaatgcaggcctccacaacaactgtttcagtactgagtggttaaattaaatattaaaagccagtgcccttaaacaaagcctgggattaacaaaagcccatcatgagttttgcctaggcctttcctaggccttaaagcatgacaaaataatgaaggaattcttaagaggacccatttaggattaaacaagttttattatgggtctgaagaaactccctaggcctccactaacaagtttactgggggtccgaaggaattccccaaaccttcatgattttgcaggagacaacataagggtaatcacccccagcaactggacccgtttagattaagtaaatttactgagggtctggaggaggctcttcaggacttagaccttagttatagattaaaagaagttaatcacttatgtatttagatgaatgcacacttacgcatagacatatagcttagaaggcatataagctctggaaaactttgtaattttgagttggtctggcaataatttccaggccttctccctataactggttgcagaaaataaaaactctcttcctctccagttcacctgcatctcgttattgggccacgagaaatagagtgatcctcactttggtccgagaacagtatgacatattacgtcacattatgacatccgggactatgtcataatttctttcttagcaagtgttttctgaaaatgcttgacctaaagtagtattcaggttaatttggattatctgaagacataccaatgtatgattggaaggaataaatattctagatcaatggtccccaatctttttgggaccaggaaatggttttgtggaagacaatttttccacggacagggcgacagggggaatggtttcaggatgaaactgttccacctcagatcaccaagcgttagattctcacatggagcacaaaacctggatgcctctaatgcacaattcacaacaaggttcatgctactatgagaatctaatgctatctccgctgatctaacaggaggcagacctcagggagtaatgccgctcacctcctgtggtgcagtccagttccaaacaggccacggcccaggggttggggacccctgctctagacacagtagaaagggtctgtatcaatctagaatttaatatatatcatacataatgcatcaactaaaatataccaagaagagattactgcattagcagaaaataactgtacaggactcaggcttcacagtgtcacatacaatagtaccttaatgttgatgatcaatcttttcaaaatgaatagctacaaaaatatatctctgcattaagtcttctacttcaacaaaatcacacaatatctttgaaagtagtcattctgacccatggtaccattatcgagatgtgaaggtgtgttgcaagaaatgtttatatttaaataatcaaaattctaagaatgatttctttgtttaaaaagtttacaaatgtgactcatttgcattctaattacttgcataagtgggaaaggggtgaagctatagctgtcaatcctgtatatgcttacaggagagtacagaacaagtgaacattatccatcctccttggcagctgaaaaagaaaaagttttgagatttgctgttttaagtatgttttacaaatacttaatataaaatataagacctcaaattagtaggttgaaatagaatttaagtaaacgtgatgggttcaaatgccagtcttcaacgtctcccacttgggagtatacttgaacaagtatacctaattggaaatatttaattatgattaatggcatacctaaggtctctgagccttactttcctaatgttaattagaaattaaatagaagttaacctacacattacagagttgttataaaactaacctaatggttataaggaatctggcaaacagtaggtgttcaatactacagcgtaattaagagccaggatttagtgaactgatcataatatagaatgagttcacacatccaagaacatttatgtataattgtagaaactctaaatgcccaataaattatttgaattcactgttgttcatgaatgctgacaagatacatatatcaagtgcccattctaagcaaacaaatccattctatgaactaaagtataacacaaaatcatgtctatacttcctcacccaaagatctcaaagcaaattagataacccaatatagcagtcttttttttttttttttttttgagacggagtcttgctctgtcgcccaggctggagtgcagtggcgagatcttggttcactgcaagctccgcctcccgggttcatgccattctcctgcctcggcctcctgagtagctgggactacaggcgcccaccaccacgcccggctaatttttttgtatttttggtagagacggggtttcaccatgttagccaggatggtctcgatctcctgacctcgtgatccgcccgcctcggcctcccaaagtgttgggattacaggcgtgagccactgcgcccagccagcagtcttaaaaatatacaagatacctgaaaaaactacagctcagggcaatcaacatctttatcaaaattttttgccacataattacaaaatgctgttacagtctaagattctttgaccttgccattaactcaattgttcaaaatataattattgagtatccactatgcaccaggcaggcactgcgctaaactctggtgtagttacagaaaagaagagaccaaaaataggaggtatgtcacaaagctatttccaactattatagtcttgttttccttaaacaatgtaagagaaaattgtaggttctcacagttgaatgcattaatacttagaaagagtcaagtaacctcaaataagtgacaatccagtatcttcccccatggagactaggagtaaaataagcacccctctatacttctccatcaattgttatttactatgtaaagataaatgaccatttcaaatatcagtcaaataatctcaagagggacactaatttaacctgtaaatttttaaaacccgtttattcctggagagttcagaaaaatgaattttaagttcgattaagttaaacgtcaatcaaaaatctatcaaaaataaactgcattcacttagttttactcaacatctgaaattatactttttctggggcagctagaattaacttactaaccacgcctccctctgatcaaccaaccactttcttgggagacaaaaatctagcctctacccaattatataatctagaattcatactatatatcctagaacattttacaaagcaagagttccctgacaaacagctacatcactattaaagttttaaagaattcttaaacattattatctagcaaaactgttctgcaaatacacattctctctctctctctctctctctcatgagttaggaaatcttactactgaagtggttatccaaaacctaagcggggacaaacagccaagtacctttttaacaccaagctccccaaaaacgaagctgttagaaaatgctgccataaatacttacagcaatagcaccatcataatgatatgcaggtaggtgtactttaggactaagagcctctcgttcgttattatggatatgaaagtcacatgaaaaaaaaaagtgctgtcatttcattttatgaatgctgattagggagtttcagttaactgcaacactttgcaaacaggctatcaaataaaccccagttatcaagcagttctagacacaaagcttctgtttctattactaaatacaattaaagaattaaaaggatcagtgtgtttttcttgaggtatattagtctaaaataatttgcgatagtaagtcaccaaacacccgagtgactgaaattcttttagctatataaaacactcctttggaatgccgatctcccacaccgtaagacttaaaacacacaaaattcactgacatacatttttcacatagagattaaggggtaaaaaggtggcaaactcaatacacttacacagaagtagcaaaaaacgtgtaagcaaattccaaaaacctttgtcttatccagaatggcactttgtggtactccaaggattcaggcatttcatcagtattccgcacataggggtactcaaacaatgttgctgacagatgagacaacaaagtctcaccaacaaacatttctacagcaatgtattaacaggtaatgttgcaaatcagtcaaggggccaagtgaggaggaatccagaggagtagaaagaatactaattttctgccaaattttacactcagaggaaattaatccatcatagaagtcttccatgaaaaaaataaaaaaggtactcagtatgacccagaatagccatgaggttaaaacacatacacacacacacacagcaattgccacttccactagagtttgacagttatagatttgggtaattatagtagaaattgcgcgtttggaaacacactaagaccacaccctaagactgagaatctggactttaaacgctgatcattaattaaaaggacaacgcagtatctaagttggaagatctggccgcgcaggtggaaggcgaagtgatggggagcgataaagacaccaacttcaaaaccagggaccaggagggctgggtgtcgaggcgaggcgaggcgaagcccgggggataagggggtgtggagctggggacgggaacaggggatgaggagaaaaagcggccgcgaagaggaaggagtggtgggagccaggattggggaggggggacaacgccgacacgggaagggacgagccaacgagccaggagtcactggcgggcgcaggatctggggtgggagggggcggcgagagcgcgcgtggaggtgccaatggaaggaagggggcggaagaaaggaagacccgaatgaatgagcgccgggggcaggccggggccgcggggccacagaggaagcgggcccggggcgtcgcggggccgggggcgggcccagcgcgcctggaaaggaggaagccccgcgccagcgcgggccccgccgcacccgcctcttcgccaaaatggggtcgcagagcaggaaagctaggagtgtgaaggaagaggggaaaatggcaaaaaccaatcactcaccctccgctcgagcctccaggcgctctcagtcccgctcctgcgccctcctggagccgcagaggcggctcctcagcggcgctagggggagccccgggtccggagcgggggagcggcggcagccggaccgggagcccctcaacacctgcccctgtggcagagccgcgacaagccaggcggcagctccgagcggggagggcaagtgacccggatgtacagggtaacgacggggagggggaggagggaatgccaggaagtgagggcgccg

SEQ ID NO: 990 - DNA, 100280 bp, Homo sapiens; identical to SEQ ID NO: 989

SEQ ID NO: 991 - DNA, 100280 bp, Homo sapiens; identical to SEQ ID NO: 989

SEQ ID NO: 992 - DNA, 153234 bp, Homo sapiens
ctgtatccagcaggctttattggctttttaggggagctgtgccgaggctggggggctgggggcaggggattaactctttccctggggcagcgctcctggctctgaacccatcaggggattttcttgggcaggggattaatgatcccactctcgatgtattcgaagactgtgtatgggtcctggtccccattgagggtgatggccgacccatacaactgctccaagtcagctgagttcctgtagaacaggtccattttcagcttgacctgctcttcagcatcctttgggttctgcaggaggcgagcctggatctccatggtgggaggtggcttgtacatgaggtggtacctgcaagggaggaaggaaagcaggtgacccatggcctggcctggaagcaggggagaaagggaccctctactctactgtggaccaatttggggtgtcctggccaccaccaccatcaccagccatttactactgtgtactgctgtgtgcacacctttgactgatgggccctggagctacagagagatccaagatgtgctccccgctcaagggagagggagagagatcagtgataggaggacagaatacaatcatatatgggcaaattctttccttcctccctccctccttccctccttccttccttccctccttccttcctatctcccctccctcccctatcctccctctcttctctccctccctccctcccttcctttctcttcttcttcctttttcttttcttttttgagacagggtctcactctcttgcccaggctggagtgcagtggcgcgatcttcgctcaccacaacctctgcctcccaggcgtgcaccattactgcccagctaatttttgtatttttagtagagaaggggtttcaccatgttggccaagctggtctcaaactcctgacctcaggtgatccacctgccttggcctcccaaagtgctgggattacaggcgtgagccaccatgcccggcctcttgttcctttttcctcccttccattcaatgtttatctgcactgagtcctgtgttaaatctgccactgacagtgccatggtaagcaggacaggcgctggctctgtgcctatggagctcacagtcagatgagggagtgggacattacagcaactgtggagatggaaggaagtactacagccgttcactgttgggagagaccgcagggacagggtgacatgaaggccacagcacttgagatgggaaagctaaaaactcccatgacaaatcaggtctacattttagaaaaatccctgcacttccttcctgcccgccccccaccccactcctgcgtccctaccaagaaatgtgaccctgactgtcaggagagatgacaacacccgcctcttagtgattgtggggtttccattgcatttcaacatgaatgcagtgattgtatttggtcagactgcagaatcaaactcggaatctacctcctgtaactatgggaagcctcaaaggcaacttgtgcccatggggatgtgtttgtacagcaaccaccactgggatgcatcgtggctcaaggaaaggccagtgaggaaacaggtgacgcccacccaaggctgctgtttcacatgctgggattaagctgttgatcccaggatagagtgggtgaacatttcaccattgtgttgctttagacataaatttcctggttattcttccaggcaaagacggtcaacagatattgcacagaacagccagttggataaagtccattttgataatcgtccttcagtggtcaccagtgttatccctgcagtgtttccaccatggcattggtcagtcagttgggtctggcccctggcagtccccagactgccaaccaccaggaacacagcacaaacctttccccagtgactggatcaattcttctcagagtcagccgctccatgatggaatcaaatggcacattcaggaaaaacaccctataaggaaataaaccatattaataatggtttttatttcctgtattttatgatgctgtgacatcctggggtcttgagaatcctggagagactgctcctcccagggctggccgattcctagagccagcaagcaatgtgcctgcaaacctgcctttcatgtacaacccaaccactccagagcctgtgtccccccaaccgcctccttcatctgactctcacaccccaaaccaatattcttcctgccctaaatcacctcagggccgggtgccaggcaactagagaccatccctgtagaccgagcttggcagaattattcaaactgcccagtcctatgctcactgtgacttgtctgcattctgggacacgctctcccctcactcctgctgccacctgaccaaccctggtgcctccccaggtcctgcagggcatggtgtgccccccttttcctgggagctgtgagtaacaaactcttctttcagtgggattgacctctctgtatcatcacctggttacctctatacattagattttgggtgcaattaagacaagaacaagcagatggtcatggggagcaaacccaggctgactctcgtcaccccagacgagggtgggcatcattttccacatgtgggtggagccactggagccactgctcagggctctgggataccacacttggaggtcaccagggacagatgcgggacagcagggctccctgcaaggacgcactaggctcccctggttcagggatagctctcagcccccatcactcctggggttgggactcccggggatgggggtcattgtttgggtgagctttgggggaacatcttgttctctagagtcacacagacttgggctagactctcacctccactatggacttgctgtgtgagcttgggccactgacccagcctctgtcagactcagttaccccaactacaaaatggggctaattatagttccctggtgttgaagatttaacaagataaagtgtgtgacaaactcagtgtgaggtctgcacagactcggtaccccagcgtggcagctgttataatttaatcaccattcctagatacccttcctgggagttcaggctccctgacttcccctgtcctccttggagaggtggaggttggttgttctcagctttctcacttcctctttctcaaaggagccctggacccaaaggagcaggacactcctgctaataagcccaaatcagaacccagcagaagagatgaagggctcacttctcatgattctcagactgggagcaccagggaattcatctctcaaactcctagttccaatggtttcatccccacccccctttttagggcaatggaacacttactttatatgaaaccttttttttttttcttttagaggcagggtctcacattgttgctcaggctggagtgcagtggagtgacctcccaggctcagtcaatctgcccatctcagcatcctgagtagctgggactacaggtgtgcaccaccccacccagataagttttgttatctatttttcagagatggggtctcactatgttgcccagctgttctggaactcctgggctcaagaaatctgcccccttcagcctctcaaagcgctgggattacaggcatgagccaccatatgtggcctatataagaccttaggagagtggttctccaccaggggtgattttgttccccagaaaccatctggcaaaatgtctggagacatgttttattttcccagctggacagtgatgctggaaagcaccttataatgtacaggacagcacccacctcaaataatgatctggccccaaatgtcaagtgcatggctgaggagccctgcctgggacagtgtgtgaacaaacagaatgagaagaggtgtggctgctctggctgggagaggtggggctggggatgagccaagacctaggagctcccacccacagagctaagccaggtcttctagcactaaatcatctggttcatttttaaaaaataacttctagaacattccattgctcactatttgctcatttgtcctttaattcatttatacatatatttatcaagtgctggctgtgtctcggacacagcaggaagttccagtgtttgccagctcaccagatggaatttaggcactaaatttaagagtctcctccttgacgacattgacaggtcctatgactggcatgtgcagtttccactggggccaaagttggtgacaacatcaacgacaacaacaagaaaacatcagtgacaacaaacactccctgtgcacccaaagccttgtattcatttcactttcaagaaagtaaactcaggccagaagcacctctacgtgcggagaaaacacacacaaatgagacctccctccttccctcctagcatgatcaaaagactaaatcaaaagattgatcgaaagattaaaatcccaaatgtggagatcctgaaagccgaattctgagagtcgtgtgttttcagcggtgcccaggctagctgcgtcatgttaggcgggactatgaccttgttattgtcttggaaactaaatatggtttcaggaggggcctatgggtgccaagctgacaacacggtgggaggcttttctgttcgtttcagactgcctcctccaagtcagtgaacaaaagcagcctctcactgacatccttggaattctccagatgtgttgagcgggctgccaagaggccgcgctttggtaggtccaatgggacactggttcccatggggcccagaccagcctttggggcacaggtgtcacctgctctgtccagagcaataacagcacgtgcccaggaaatgcgtgtgaaggaatgaagaaatgaaccaacccatggtatccaggcctagaattctttttaaagtctctgcccactgcctgttttttttttttttttccatccttgccaaaaaaactcatctaactggtagaacagagagtgatctaaaaccctagggttgggcgggatcttagacatgtaattcccaggggccagttgcatcagaatcccgtcaggagcctttgatggtggatgcctatgccccttgcccagaactgctcagtcaggggcattggagggagcccagtgtggccctggtcactggaatccactgccttggaaaacacctgggtcagggattctgagccaggcaccccaaaggtcctgtgagccccggaaattagatacaaactgctgactacatggagaatgtgtgccctactgggtgttgggtgggctcatcagattctcagaggggtgctggtccttaaacatcattatgaatctgagccaaaacctcatgttttacagtgagatgaggaacctggcctcgggaaagccggggctgcccccgatcctgcatgctgtcctcacactcactgttctccttggcttgtagacgccttttcattctcctgattccctctgggagccaccttggccccctcgcctccctgtggcttggctggaactaccgggtatggatcataatcctgaaagacggatcccaaatgtcacaatcccaaacgccgaaatcctgaaagctcaaaatccctaaagtctaaattctaatgtctaaaatcctgaaaatcacaatttcaaaagattaaaatcctaaatgtggaaatcctgaaagccgaattccgagtgatttgtgtgttttcagcagtgcccaggctagctgcatcatcttggaaactaagtatggtgtcaggaggtggctatgggtgccaagttgacaataggtggacttgtggacttaattttatgtgtcaccttgactggatgaaggagctcctagcaacgtggtaaaggattcttttgggcgtgtctgtgcaggtgtctccagaggagagggctgtgagtctgagagggtgggtggggaagccctgccctgccctcagtgttggcacaccctgtgtaatcagccagggttctggagagaaccaatacagaaggcgaactggtctctctctgagggctggacaggctgtgcttctgctgctgtggacatcagaaatttgatttcatgaaagggcttatcacaaggctgagtgtgtgtgagcactgcatatggacatggaaagtttaaaacttcctcagtaaatgacgagatgtcctatttatgcaactgcatttgagaaggataaagtttcttgagagctcagctctctggatgactacatacgtggtgctgacccatctgggtttttggtcaatcctgtcaaaagactcaggttgtgctgaggtgggaggatcccttgagcccaggagttcaaggccagcctgggcaacattgcgagaccccgtctctgaaaaacaaaacaaaaaacaaaggtaggtggtctgtcatggtatttcagatgaccacagttataaagctgggttcccacaatgaccaaccatagtaatatgcatttatatatttcatttttaacctatttctttatgaagatggttcatctgctcaaaactgtaatacccgtgtgatagttattagtgtacctgagtgtttatgctcagtgtacctgagttattatggccaattttattgtgtaaattggcctacaaagtgctctgtggtgtttttaatatctcaaaaaaaatccccttttctatatgtaaataaacatcatttaaataattaaacaatgtttttttccacaattatatttttgggattttgatctttcagcattgtgattttcagaattttagacattagggatttctgacctttcagggttttaacatttgggattatggcattcaggattgtatcttctatggcattcaggattatatcttctatggcattcaggattatatcttctatggcattcaggattatatctttcaggattatgaccggttcctgaactagtttgccccagggctgcagggctgggcctgagggaggcccagaggtcaccagtctgagtgctggctcctccaggccacaggaatttgtttagaatgcaaggctgatccaagccgggtctatgagaagccaccccagggcttgccggagagaaatgagcctcatttctgatgaagctgaaaaggcaatgaagtggaagcccggggttccctggggcctgcacccaaagagagcgtaactgagaatgaagttcacgccacgagagcagaaagatggtgagagacattgtttggggccctggttcaagctgtgcctgtagccagcctcaggcacatgaatatgtatatattcatgtatgtatgaatatatacacctcttctcttgcctaggctgggtttcctgcaactgttacccaaaggacacatcatatatccagtttttccagtgccacttgcttctagaaaatgtgtgaacttaaaacaactatgagtccctgagccacaatctctttctccttcgaggccagcttctcccgtggccttgcttctctctctctcactttgcccatgctgttcgctgagctttgcttctgcccagtcgccaggaagctcctcactggtgcctgatgaaaactgcagctgcccctccaggaagcgagcccaactgtttccccagcagcctggagcggctgggagccatgaaaagcccatgaaaagccacgtcctccttgcacatgtgcttgataatgacttccattcacaacgtgctgcaaaataacagccactaaaaaaaaaaaacatgcgagatcggggagtgtgtaaacacagggagtgcaggtgtcgcagcggctttcatccctgacgctgtgaacacgcggccccccttgcacccccggtactgcaaggcccaacggcaacaccaaaacacggctgtcacggcggctggcggctctggatgccgacgccagtagaaaggaagccggtttggaaatccctgataattgaagctgcttcataaacaagccccatttgaaagacttttaacccagcgtaccaagactgcttgtcgtcattcaagggaatggcttgtgaaaggctggcaagatgtgacgcacaaggacaccaaatgggtgcttggagcacgctgctggggacagcctcgctgcggagggccctgctccatgctggaagcttctgattatcctggctcattgcgcccaatgtgagggccaggtggcagggtgcaggggcagcccaggccacgctgctgagagctactgctctgtgcatgccaccagccactggttttttgttttctgctgtttattacagagccaggaaagggagaaaggtgaaagcaaagaatactcaaaacagggtgtgctgggcagaccctcctggtgtgggtgagggtagtgggtgcctggactggccaggggcgggcactctacctgcccctgggattgcagaacttcaggctggtggatgcttccggaagggaggtggaaggtgttttgggaggcctctaatccctgctccaggtgggcaccctggatcagctgcctcagcacctccccagagcttattaacgacacagatctcaagccccactgcccacccactggagtccatgttttaacaagatcctcagtgatttgtaggcacattaaggttggagaagggccactctgacccgtgcttccaagatttgtctggtgttgagaattatctggaaggcttgcgtaaaatacagattgcaggcaccccttcccccaagagctactgaaccaaaacctccaggtgaggggctgggagacctgcattcgtaagtcagaagctcgggtgatgttcatgcccaggcaggtatgggagccatggctctaatccatggtctcatccttggccgcaccctgaagccaacaagagctttgagcgtactgaggcctgggcaccactcccggagattctggtatacttggtccagggtgaggcctgaaaatgggatttttacaagctcctcactgggtatggtactcacgcctgtaaccccagcactgtggaaggctgacacaggagcatcgcttgagctcaggagttcaagaccaacctgggcaacacagtgagaccccatctctacaaaaagtttttaaaaattagcccagtgtggtggcgcaccgatagttctggctacttgggaggctgaggtgggagtgtcgcttgagcccaggagtttgaggctgcagtgagctacaatcacaccactgtactccggcctgggtgacagagaaagaccctgtctaaatacataaataggttgggcacggtggctcacacctgtaatcccaatagtttggcaggctgagatggacggatcacctgaggtcaagagtttgagaccagactggccagcatggtgaaaccccatctctactaaaaaatacaaaaattagctaggcatggtggcatgcgcctgtagtcccagctactcaggagactgaagcacgagaatcgcttgaacccgagaggtggaggttgcagtgagtggagatcgcgccactgcactccagcctgggcgacaaagcaagactccatctctaaataactaactaaatgaaagctccttgggtggctgcaatgtgcagccagggttgagcaccactgccctgattcaatctacttagtctactgggtcccagagagctgaggggttcatactctgtcactctgagcattggtgtcaggtatccaatgacaactgggatcccctgacccaccctggtaacgcccactctagccacactgcctgagattctgtttgaagaacacaggaagcctccttcctcaatgaccttgaagctcatcccctgctttcatcactagaaactgagggtgaaatttactctggatccatggacggattgggtaagttgagagatacgatgtacaataactgactgcaaatatgatgcccggttctgcccagaggcaggggcctgactgtgttggcttcttgatcttaaccaataagcctccatgattgcaaaaccctacacaaagcaatatgacataaccacagggagatactacttcacactcagtagaatgactattacacatttaaaaaaaaaacccataaagtaagtgttggctagactgtagagagattggagctcttgcacattgctgctggaaatatagcatggtgcacctcctgtggaaaatgctatgctggctcctcgaaaaattaaacatagacccagcagtaccacttcggaggatataaccaaaagaaccgaaagcagggacttgaacagatatttgtacaccagtgttcttagcagcatgattcgcaacagccaaaaggtgaaaacaacccaactgttcatcaatagatgaatggataaacaaaatgtggtctatacagtcatgcgttgcttaataacagggacacgttctgagaaatgtgttgttttgtgaacaccatggagtgcacttactcatacctagttggtatagcctaccacacaactaggctgcagtcctgtacagcatgttaccgcactgaatactgtaggcaattataatgcaatggtaagtacttgtgtatccacacatacctaaacatagaaaaggcacagtaaaaatagggtatcagaatcttatgggaccaccattgtatgtgtggtctgtcattgaccaaaatgtcgttatgcagtgcatgactgtacatacgatgaaatactattcagtctttttttttttttttttgagacgaagtctcgctcttgtcccctagtctggagtggaatggcgcaatcttggctcactgcaacctccgcctcccggattcaagcaattctcctgcctcagcctcccgagtagctgggattacaggtgtgtaccaccatgcccagctaattttttgtatttttagtagagacggggatccaccatgttggccaggctggtctcaaactcctgacctcaggtgatccgcccacctcggcctcccaaagtgttggggttacaggcgtgagccactgtgcctggccaatcagtcttaaaaaggaataaaatttgggctgggcgcggtggctcacacctgtaatcccagcactttgggaggccgaggtgggcggatcacaagctcaggagatcgagaccacagtgaaaccccgtctctactaaaaatacaaaacattagccaggcatggtggtgggcgcccgtagtcccagctactccggaggctgaagcaggagaatggcgtgaacccgggaggcgaagcttgaagtgagcagaggttgcgccactgcactccagcctgggtgacagagtgagaatccatctcaaaaaaaaaaaaaaaaaaggcataaaattttgacacatgctaaaacctggatgaaccttgaagacattatgctaagtaaaataagacagatacaaaaggacaaacattgtatgactccactttttgaggtccctagggtagtcaaattcatacagacagaaagtagaatggggcttccaggggcagggggaaggggaaattgggaattagtgttttaatgagtctagagtttcagtttgggatgacaaaaaagttctggagatgagcggtggtgatgtttgtacaacaatgtgaaggtacttaatgctactaaacttacacttaaagatggtcaaaatagtaaactttatgttatatatatttaacacacacacacacacaaacacaagtagttagtagacattacaatgaaggcaactgggggagagaagttctctgaccttgaataaacttacaatttaatgaggttctgaatacatgcatgtatacatataaacagatggacaaaacaatgaaccatatgacagtattaattctacacaaactataatgcaaatactacataaactctttcagaaaatagaggaaggaatactgattttattcgtcagcttttccttgataccaaaaaccagacaaagacattaaaactacagaccaacatccctcataaacacaaatgcaaaaatcctcagcagaatattaggaaatttaattaatctagcattacataaaaagaataatacatcacaaccaagtgggattcagcctgtgaatggaaagctaacattcaaaagtcaatcaataagtaattgactgtatcattagaagaaaaagtttataatcatctcaacagatgtggaaaaagatctgacaaaattttacaccaattcctaacaaaaactctcagcaaactagaaatagaagggaaagtcctcaacccaataaagggcatttacttaaaaactatagttaagatcatacttaatgcccaaagactaaacactttctccctaaaattgagaacaaggcaagaatgtccactctcacttctactagtcatcatcaaactgtgagtcctggattgtacaataagaccagaaaaggatacaacaagcaaataaattgaaaacactccacctctgagtaccctgggtgtgggcggtctgagcacaggtgctgggacagccttgtgggcgctgagtccttcattcctggcatgtgctaagtgctaaataaatatttagcacaagatttcccattgctgaattacttttttttttttttgagacagagtctcactctgtcgcccaggctgcagtgcagtggcacaatctcggctcactgcaacctccgcctcccgggttcaagtgattctcctgcctcagcctcccgagtagctgtgactacaggcgtgtgccaccacgcccggctaattttttgtatttttagtagagatgaggttttactgtgttagccaggatgatctcgatttcctgacctcgtgatctgcccgcctcagcctcccaaagtgctgggattacagacgtgagccaccgcacctggcctaagtatcttaacatgggcagttttcacatcttcaagtttattcccaatgactgttcaactcttctttttttttaatttaaaaaagttttaaaaccaagtgcctccttttctgttgatcggtacaatttgatcacaataaatatgtcctttatagctcagggtaaattcaaacattcataagaatgcaaataatactttgttcagaccacagtttgctgctctaatgaaactattgtccatttctagctagactgggatgggaggggaagttcagggatgtttcccttgggcaacatctcgtttgaggcaaggatagtttccaaaggaagtaatccaggagatacacttggtcattggtggacactattacaacaaacaacgcagaaatatgttcatgactttttttttttttttttttgagacagggtctcactctgcccccccaggctggagtgcagtggagccatcatgactggctgcagcctctatctcccgggctcaagtgatccttccatttcagtcccccaagtagctgggaccacaggtttgtgtaccacacccagctaattttttaatttttaattttgtagagacttttcttatgttgcccaggctggtcttgaattcctgggctgaagtgaccctccaacctcagcctcccaaagtgctgggattataggcatgagccaccatgcctggcctgacatattgttaatttaaaaaatcaggttatatatcaggtaatactgtttgatcccactaaaaaaatgtatagaaaagaaaaagactgcaacattaagaatgattatttctgggctgggcgtggtggctcatacctataatcccagcactttgggaggccgaggcaggtggattacctgagattaggagtttgagaccagcctggccaagacggtgagaccccgtctctactaaagataagccaggtgtgatggcagatgcctgtaatcccagctacttgggagactgaggcaggagaatcgcttgaacctgggaagcagaggttgcggtgagctgagatcatgtcactgcattccagcctgggcaacagagagtgactctgtctcaaaaaaaaaaaaaaaaaaaaaaaaaaaaaaaaaaaaaaaagattgttcctgcttatctttctctttttagctccatatatttaaaaaactttttacaacatatatgatttttgtaaagagaaataagccagagttgtttttgttttgttttgttttttaagtcaacttcaagccaggcacagtggctcatgcctataatcccagctacttgggaggctgaggcaggagggcttcttgaggccagaagtttgaggccagcctgagcaacacagtgagaccctctcactaaaaacaattaaaataaaataaaaagtcaacttctactaacatggaagtcaggaagaaaagagaaatgctctgtgtaccaacagcaacagccctgccttctataaactaggtccaggccccaagggggaggaaggcaggttgattgggggcgggggtgttataaagtagtggcagaacaaggcccttaccttgtggggcaaagtacgcattcttgttctgttcccacacagtggcatgctggtaaaccagcttttagcagtgaggagggacgacccctgatttgtagcatttgccaatatccccatctagtaaatttcaagctgccaacatggcgtccttaaatgcggaagagaagtgcacattcagacctcagcagctggtgcagcccagttctagcacgcccctgccacagcagccccctaaggcggagcacggattactgttcccattttaccaacacgggtactggtcagacagccactttttatcaggcactgtgtttaaagccaggtgatgtaaatgtctggttttatgtaatcctcacaacacccaaatgaggtctgggtactggattatgcttacttttcacatcagcaaacaaatgaggcctagaaagatcacatgcctgcacaaggttatttggctaaaaagaggcagagacttgaacccaggactgtctgctcccaagttcgtgcccataaccacatgggggtaccagttctctccatcacggagctcatcttgcacttagtggccgtgtgtggtgggctgagttacttgctttgagccttctccagaggtgtgagacatggaatagacatttctagggaggtgagagggaagaagtaaggttcccgactacgcagtggaatgagcagctggaatgggtgggacttggctctggtcggctccccgtttggatttggggatgatgaacagagacctgtgcacctctggcctcctccagtcttagagctgagcacccccccgccccactctggggctgcatccctcacctgcacggtgggcccaggcgaggaacccacccaggccttggaaagtacagttgatgaacggtcatcttcatctccagggctgcactcctcatcagatgcatttggctccttcgctgatggatggggatgcagaagagttgaccaatcctagtgtccagaagacttctttgaggtggcatctggtgtgtttgtcctactctcagaagatggtgggcctgggggtcctatccccagtcaggaccctcgctatcatctgcctgttcccaagtggcacctggccacccagccttcctgccacatggtgggagtgccttttccccccatttcctgggggcaccctgggcaagctgaatcacccacggcaagcccagccagtctgtgccaggtcacggcaccatctgcaccagcagctctcaggtgcaggtatggggcacaggagcacactttaaaaactctggccgagtctttttcctggttccaggcagggcctgtgtccgaatccccccgacactgctccttcatgcctgtgcacacttggaagttagcagtcagtgcagacaaagttcccgcatgctcctggaaacccaccatcttcactgggcactgcaccacgccttctacctggtactccgagctctaacaagcacttagcttgacagtgggaacactgatcaacactgaagtcgctctgtttggacgccagtcaagatccattggtcagcaacagccccccaaaaacagctgggttggtgaacatttcctccgtgtcctgaggtgtggccgatgccaagaggccccactcagatcccccttccagaaagagctcagctgtaaggggtgggtcaccgcagcctccaactgaagcatcgtgagggtcttgagccctagttttcgtttttgtttttgttttgacatctttactgagctataattcacccctgtaatgagtctaattcaatggatttagtatattcagagttgtgccatcatcaacacaatctaagtatggaacattttcatcactccaaaaggcaaccctgtacccatgaacagtcacttccccttccccagctcccagccctaagcaagcactgatggactttctgtctctacggattttcctattctgcacatttcacaagacatggctctccaagtctccacctaggataaaaagaaagaggacttcacaagattgtcttaaggattaaatgagatgacccatagaaagcacttaacacataattacatagaatatccacgagggccaatgtgccaggctgctttcactcagcctgatgttttcaaggttcatccagactgtcgcatggatcagaacttcattcctcgtgcagccaaacagtgctccattctttggatctatcacattttgtttatgcatccacgagttgatggacttggactttttttttttttttttttgagagagatagagtctcattctgttgctcaggctggagtgtaatgacacaatcacagctcactgcagcttcgaccttccgggctcaagcgatcctcccacttcagcctccctaacagctaggactacagcacatgccactactcccagctaatttttaaaaacattttttgtagagacagggtctcaccatattgcccaggttggtcttttgggctcaagtaatccacccaccgtggcctcccaaagtactgggattacaggcgtgagccacggtgctagccaaccaatggatttttaacccaagcttttgaaccaaggtcacactctggggtgacctttggccaaaaactaagcatgacaggggtaccagcacctggcatttctgcccctcgcagccctctgaggggctgtgccaggtctgcgtcatgatccatggctcctcacccaccttactttgggctcttttcctggtacaggtgtgccttccccattaactcctcttcactcctgaccctgtctcagcatctgcttcccgagattgcatcctgacaagacacttaatatgtaataacaacacagaacccacgtgggcccacacaccagcactcttctattagcctccgtgaggccacttcatcctcatcacaagcttgagaggcgggggtgtcattagaacagatgagggaaccgagggacagaggagttcagcaaccaatccaagttcccccgccagaagcgatggagccacgactcaacccaggtgaattctccagtgtcggtgcccttggtcacagcactccattgtgattccgctgaaggaacaaggggaggaggggggcctggcctcccactgctcagctcaagccacaagccctggctgcgtgtgtagctttagctccccggggctgtgctgtgaggcccaggttcagagccagctgcagtcaatgtcatctttctccacctgcaacagatcagctggaagagattcgaggcaggaaacacagcagatgctctgccatgggggcccacccacgtgcctctgctcgcgacctgacctgccgtcgggcggccccacaggcacgggtctgagagcagggtgtgcagatccaggatccctgggtcacctgggggacaagtgcatctcctcgtcactggtcactggaaacagggcagtggagacacgggtaggtgtgctaattttgaggtttcctttctcagagtcagtctccatcagtgacaactgctgctttaaaatctgtctctggtgaaaagttacataagcacattccagtgttcctctgccacagcactgtcgctacccaccgccagattccccagccttgacttctctgctatgtatgtacctatctatataaacgtgctgcagagaaacctgtcttttaaccttttctgcagctggagcttttccatgaatccctctgtctacaagtgttttacttcttggttttaattttaatcctttgccttccattaatcagcaccaaaactgttttattgatatttcctacctgccgggcactggtagtaagcacgttacatgcacgtgctatcttatttaatcctcgtgagaagtacacgaccccggtactgtgatcgtgcccatttcgagggtgcaaagactcgggctctgagaggtgaagtgttgcctccaggctggactccagggccatctgaatctaggacactccgttgctgctccgctaagttctcagatgtaaaataatcgtgctttgttccctgaagttggcggagccttcctgaaatctccagtgaggatcaggagagggacagtgaacctgccggaactcaagccagctagcgggagggacgggggttgaccctgcttatgtgcccccactctcccggtgtgctagaccccacctcagactcctctgtgtcccccgttacgtagggggtgtgccggctcacaccctccagtgtgcctcactaaggacacagggcacagctgcctctcaggactaaagataaattccacagattccaaaagacccttcgtccccaatcacagctgccttgcctaaagaatccaccaccgtggttgttaaacccacactttaattactccaaaattatgttaaatccttgcataaatattgcagtggcatcttctgaagaatttcattacagtaagttgggttgctgccagagctctccactaaaaagtaacaggagaatagacacgtgccaaaaaaaaaaaaaaaaggatagatgctgttttcaaaataaaaaggcaaggaggtcatcctcggtcagatcacgcaggtgtcaaagagaaacggtctcatgatagcagaaatctcccattttacagaccgaaggggaaaaacataccctttagccctctaatctaataggattcacttctggaaaaacctaaatctgattaaatattaataaccagtggtattaattaagggggaaaagtccatcaagagaaccccaatatgtttacagtgtccccaggaaactgggaaaattcacaatcaagtgtgtaaatgttctaagaaagggtcctgaatattttatgaatatttgtcataaaacagaaataataaccactgtgcagagctattagaattaatatttatgctgcccgccatgaaatattcatggggacagagaaaggggggccgtaagacaagaattaatttacactgggctcggtttacccgctggcttgatgtttaaagacggttgacaagcctccatatgaatccgccagtcacttcccgcagtctgcggagtggagggggtggagacgggtccgggctgctgacagctcacagattgagtttctgacagcccttaaaaaacctaaacggcccccacctatttccccttcttccattgcccaaagcgctctgttctgccaccgttcatccgatctccccttccatctgctgaaattaacgaattaatgagcgagatacgctttacggtggggccttatgaatgtttacaggcgattaaattataatgcggggcggctgtataattcatgaaccaattaaaggaagtgttagttgatttgatgggatgaggacgtacaaaatgcatttaactaatggggaaccgcgggctgcccagggccggctccctctctcggattacgcggctaattgctcgactttacggggctgtcacagatagccatgcatatttcattgttctcaaatacttcaattgtgtgcgtccgtgtcgcggctgtaatgtggagaaggcgggccaaacttgggtgtagttacagtacccgagctgggccccggcagaaacctgagctccagagtcgggtgtctgggccattaggtgattaaaaaggctcagcatgcgatcgccttttgttttactatgttctcttcgggacactaattccggatgctgacttcatgaccgtggtgacactggggccctgatccctttctttccgggtagtggaggggaggtccacagccccctgtattgttcacaccctgtgtgccctcgaagcccaatgtccccagtgcaagggtccctcaagacagtccacctgagacaatccccaagctaagggtttccctcaggcctgactttgtccatccgtacaaggtggccaccaggagcttctttaaatgcggtctaaacttggacccaaacttgaagctgtcatcagctccttgaagtatgtttggaaggaaatcagcagagaagagcaaatgcaccctccccaaggagtaaaatgatcctggtgctcaggaagagagaggatgcttccagaattctgtgagccgaaggacagaggagacaaaggtggctgacttcccagctggagcaacggggatgtcgagtttagggagacgctgccttcatccagcaatcctagtgcactctgtggggagcagggtgagaccatcggagccgcgcagccaaccagtcagtcctctgagatggttctattctctcctctcgcttccaagccagtctggcattcacctgagccaagcacatgcatgcacacacacacatagacacacacacgaaacaaattagaagccctgtggttaccaccttcagtcctcctgtggatacctatgaaagaatgtattttactcccacttttgcgagtagggcctgggcagcagccagagctggggctctggggtctgcactctcaggatcaaggctcatacccttctgcagacaccaggaatgcatggccaagggcagccccaggttccccatctaaggggacagggatggcaacaggtgaggaggattaaaggcactaacccgtggccttagcatcgaggctgatatgtgataatcacccaatttagttagccaatactattatcacatgctaatagagattccgacttgcgcaacagggaggctctatccatcactttcctcttccacaaacgcacatgacagtcggggttggcttccaccccttaattgcgcagtggacagtgtgctgtcaaatggagcaaccagtgaggtctacaagaatgccttacggaggcagcaaaatagatccaggtggaaaagttgcaggaacccccgggccacacgtgaggcgagcactcagtctctgcctcgaggatgaaagaagggccaactgcacattaaaagaaagtaagttcacttggtctaaaatatttaattggggcctaattgaaaatgaagtatcaattagtagtcaagctgggtttaatgcattctggtttaaaataaaaccaaactatcattcatcaaatacaactgccttaaatattttacagttgttactttatatcatcttgcaaagtaaacagtattctcaatgcatatatgcggcaactgaggctcagggtagccaagtatcttggttcagaaatttattttaagcaaatatttgtgcaagtgtaaagatatatggacaagatttctcattgctgaattacttctttgagacagagtctcgctctgttgccaggctggagtgcagtggtgcaatctcggctcactgcaacctccatctcctgggttcaagcgattctcctgcctcagcctcctgagtagctgggactacaggcgtgtgccaccacacccagctaatttttgtatttttagtagagatggggtttcaccatgttggtttcaccatgttggccacgatggtctcaatctcttgacctcatgatctccccaccttggcctcccaaagtgctgggattacaggcataaggcactgcacccagcatttttttttttctgagatggagtctggttctgtcacacaggctggagtgcagtggtgcaatcttggctcactgcaacctccgcatcccaggttcaagcgattctcatgcctcaacctgtagctgggattacaccatgcctggctaattttttgtattttgtagagagggggtttcatcatgttggcctggctggtcttgaactcctgacctctagtgatctgtctgcctcggcctcccaaagtgctgggattacaggtgtgagccaccatgcctggccttactttatatgtctggttttaattttttaattttaatttttttttttacaatgagactgtactatttctacaattaagaaaaacactaattataaaatcacaggctgggcgtggtggctcacacctgtaatcccagcactttgggaggccgaggcaggggagttcgagaccagcctggccaacataatgaaatcccatctctactaaaaatacaaaaattagccgagcatggtgatgggcgcctgtagtctcagctacttgggaggctgaggcaggagaatcgcttgaacccaagaggtggaggttgcagtgagctgagacggtgccattgcactccagcctgggcaacaagagtgaaactctgtctcagaaataaataaataaataaataaacaaaatcacaagaacaggtttattgttaaagacggaaaagtgtgcattttcagctacaggaccaacataatggtgataacacgtagataaccgtaagactggaccggaagttcttatgcgcagatcataaaacacacagatttaaagcttcatgtgtctgagcagtgctctcagtctcttatcaaaccccccatatcactgtggaatcagaacttcatttcaataagagtgggcagaatggggacaaggacacagcagatgctggccactgagaaggacaaagagtgggacgacctttcacccaggtgccagcctcccaggtgctcaggtgcgagagggctcaggtgaggaagtgtgaatagctcagtgcaaatcaatgcctctggtttaagaaaatcaaaagatgttcattcattcattcaacaaatatttacccagtgcttcctagatgctagttgctggctgccctaggaactacagatctagtggtgaatgagccaggcacattcctggcctcccacagcttttaccacgtgtgtttagatacacacagacaccatctgcccgtggtacttggggttgatctcgatattaaaagatgcaaatatgtactatgaaaagaccagtttgcaatcggcaaagggatgagatccacaagttgtttgctaaatatggtttggacaaggagggtgaagtacacactaatttcttggatggataatttttctgatgaagtggctaagttgtgtttgtttgtttgtttgttttgagactaagtctcactcttgaccccaggctggagtgcaatggcgcgatctcggctcactgcaacctccgcctcccgggttcaagcgattctcttgcctcagcctcctgagtagctgggattacaggtacctgccaccaagcccggctaatttttgtatttttagtagagacgggtttcaccatgttggccaggctggtctcgaactcctgacctcaggtgatctgcccatcttggcctcccaaagtgctgggattaccggcgtgagccactgcgcccagtaaatatttacaatgtttttcacgaactaagcatgctacataacataatttcacgcaatcttctctttgtaggagttaggcacaaccaccatcccctatttgataggtgtgggaactgggtctcagggaagttatgcagcttctcaaggtcccatccctagtaaaggcaggctctgggttcaggtgctggacgctctggcctgccataaccactgggcactaccgcctccctggatgctcttgtgcgaggcccctcgtaaggtgtgctggctcttcaggtgccccgtgcccggcactctgtgaggatgcacaggatacctctcactgcgtcttcatggcaagcccgggacgtaggtgtaactgtcacccccatcttatggatgaggcagcttgccccgatatcggctggtgagtgacccagaagaactcgcgactcacagctgctggactctaacatccagggtgggagccactgggctgtgttgctgtttcccaaatgcaggaagtctcttaagtgcttcatttactctgttttttttttttcttgagacagatttgttcatcgataatttttattttttaaatcgatatgaaaatcctcttgcaggggtggactggagctgagggcacttgaaggggtgagtgggaaagcccacagccaggagccaccagaaccggcgcagagaacagacgctgctgcaggaggccatggggctggtgttggggtgggcgtgcacttgccatccttttatttcttccccaacctccttcctctgtcttccttacctcgagatactgacagcacactcctagagatactgacagcacactcttggagatactgacagcacacttatattgagtttctgccatgtgtacgcatcttggggaggcctgggaggccctgatgcatcaggcttcttggcctctctgtgcccacccctgaaccagcctctcttccttcacctcttctcatgggctctgtcatgcaggctggagtgcaatggtgcgatctcggctcactgcaacctccgcctcctgggttcaagcgattctcctgcctcagcctcccgagtagctgggattacaggcatgtgccaccacacccggctaatttttgtacttttagtagagatggggtttcaccatgttggccaggctggtgtccaaatcctgacctcaagtgagccacccgccttggcctctcaaactgctgggattacaggtgtgagccaccgcgcccggctcctcttcatttcttctacacatctttctgtccggcatcggggcagcagtggccaacagaagacatacctctgtggccttcccagcacaattccaaggacttccctgaatattccaactctgggacatcccctctgagctttcattccaggaaaaccacgctttcttctcaaatttctaaataggattggaagctcttacttgtggactagcaaagataagggttcagattctagcgcttcaaaggactccatccggtgaatcccaccagggcgcgagctcccccatgagagcaacttcagagagaagctcccttaggctccctcccctcccaaatctgcacctaacgtcaggctgcatccagagataccaatggaaattaggtacaaattgtaccctggacttgactttgcaatcggaagaaacctcgatttgtgggggtaaaggtcaccgcctggaaggcctaacccagaggccagccctgtggcttggccaggccaagagaagcctcccctaactgcctatggaaaagaacccagggttaaactgtttatctgggttatgctcccaggttaaacttcttaagtgaaccgacccaaggaggtgaaacctgaatttctagataaagcttttccacgtctttggccaggtacacagaactgcaatttaaaacttctgggttttatgccgggtgccgtggctcacgcctgtaatcccagcactttgagaggccaaggcaggccgatcatttgaggtcaggagttcaagaccagcccggccaacatggtgaaaccccatgtctactaaaaatacaaaaattagccgggcgtggtggtgcacgcctgtaatcccagctactcaggaggctgaggcaggagaatcgcttgaacccgggaggcagaggttgcagtgagccgagatcatgtcactgccctccagccaggatgacagagtgagactccaaaaaaaaaaaaaaaaaacaaaaaaaaccaacttctgggttttgctagttgtctgcgaattaagtctatgattccagctgagaagcctgcaacatcctggtggttgcagtgagccgagatcatgccactgcactctagccacgatgacagagtgagactccaaaaaaaaaaaaaacaacttctgggttttgttagttgtctgtgaattaagtctatgattccagccgagaagcctgtgacatcctggtggcatctcccccaagggccatcaacttgtgataatcctggtccttgtgtgacggctgacgagcacaaatgctctcaaagaagtactgtgcagccactgacggtgaggctggggacagtgtttgtgaacacgggttcatggtatattccatagaggaaagggctgtgatataatgtgtgcaattaagaccctgttttcatttttattatttattttcttatttttttatttttgagaaggagtctcgctctgtcgcccaggctggagtgcagtggcgcgatctgggctctgcaacatctgcctcctgggttcaagtgattttcctgcctcagcctcctgagtagctgggactataggcatgcagcaccacacctgactaattttttttgtatttttagtagagatggggtttcatcatgttggtcaggctggtctcgaactcctgacctcaaatgatccacgcgcctcgacctcccaaagcactgagattataggtgcgagccaccgtgcccagccaagacctgtttagagtagtttttaaaatattggaatagacatacacccaaatgtcaacattagttatctttggatattggaaatatttttacttagctacattttctaacttttttttttttttttttgagacggagtctcgctgtcgcccaggctggagtgcagtggcgtgatctctgctcactgcaggctccaccagctgggttcacgccattctcctgcctctgcctcccgagcagctgggactataggcgcccgccaccacgcctggctaattttttgtatttttagtagagatggggttttaccatgttagccaggatggtctcgatctcctgacctcgtgatctgcccgcctcagcctcccaaagtgctgggattacaggcgtgagccactgcacccggcctacattttctaacttttctacaataagtagatgccctgtgtaatcaaatgtttgaaataaccaccttcgccacaccctgcccccaccttgttcctccagtggcttcccttcccccagctctcctggaatgggcctggctgtccctggcccaggacatggacgctggctgccccccacccaccccacctgcagaactcttcctcccctcctcctgcagctggctccttccttccattcaagtctgagcttaaaccagccctcctcagaggcaccttcccccaccagcgcatccaaaccagtcagcttgcccctactccatcatgccatggcattttaatcccacataaagcacttggtcctagcaggtatttctgctctgtttatttgtctaacgtcgcctcctcccatgggaatgttttgcttgtttctgtggccccagcgtctggaacggtgcctggcaaagagaagcctacaataaatacttctggagcgaacaaattgaagtgtaagtccttcccttactactaggaatagcagctgccacaactgggctccgagctgatcattctacactggggaatcacgccgcattcccaggaggaaggagccaggccactgttgacctccttttgtcctggggaatctgaggatcagagacataaagtaacctccctgtcacccccctagtaagccagctggttctgggctctctcatcttgccgctccactgccaagaacaacctccatcctatgctaggggctgggcctggccctgcaggatgtgggcctggctggcaggcagccctgaccctctgcctggccccagtggcagggtccccacaactcctatctgggaagggcttaggggcagcagcccagttagaactgctcattggacatgttcacaaagctgcacacactgtttactgagacgatggctttatttggggtggctggggcagagagagctcatgagtgtgggggctgaagccatccctggactaatccccaggtactcacatcctggtagggaagggcccctggcacaggctcaggctggtggctttaagccagtttccttgctggagggtatgggtcatccccagggtggcccagctggggcggaagggcaccctcgcagtgaggggatccccgctgtggagagcatgaagcccctccatgttctctagggaaggagacaagtgggcaggagacaagtgctctcacgccccatccctgcagcctcctggagtggcacgcaggtgacaatggggactgcagggagcatgcacgaaggtctcctcttcgtatttactcatccagtctttccactgccgtctgaattaggtcccatcattgcctccattttatgatgcagaaggagccctccaggtgggataagtcattcagacagcgcaactcacagagggcactggagcccggagtgcggttccagaaggcagctctttgccgtcacaccacactgtctgtctctaaaggacccactgcagggtgacttggttaacagctgagaacccactgaggtcagcagaaactccaggggaagaagaagagggcacatggccgcctaggatctctgcaacaacatgctaccaggagacggcacaacacgcaaggtcgggaaaggggaagcagatgatactctttgatgtttctgaagtacctccgccacaagcaagcacagagatgtatttcagtttgggatagaaatggctatttgcatttcatcatctttgagcaggactgcagacataaatgggacccatgatggagccaaatcagcatattgcagtgtgagcccgaggtgatatccagcaggcctttgagaggtgtgggcacccagcgtgtaacactggcattaatcaccagtgactctgaatgttcgtggaagatcagtaagcatgcaaatgagagaacaggatcggccccatccccatctgattggaaacatatcaggccgccccctttcatatcaagtttccattgtaaagagtaaaactttcaatggccattcctcttgccgctgccctctctgtgatgctggtgcttcctcctgctgctgttcccgggaggacagttgagccaagggcagcttctcctcctctccctcccctagccatgcctatcacacataaggaaccaacagtttccaatttgattccatttttctccaactacttaaagaaaaaggccttacagccaaaacattaccactgatttttgttttttggttttttttttttttttgagacagagttttgctcttgttgccgaggctggagtacaatggtgcaatcttggctcattgcaacctccacctcctggattcaagcacttttcctgcctcagcctcccaagtacctgggattacaggcatgtgccaccacgccaggctaattttgtatttttagtagagatggggtttcaccatgttggccaggctggtctcgaactcctgacctcaggtaatctgcccgcctcggcctcctaaagtgatgggattacaggcatgagccaccgtgccccaccttgctaatatttttatcagcatcttcccttcttttagctgacaggagcaagcacttgctgtcatgccagaatatttggattacaacttggttatctaaaagatttggcaggttttcatattttccatgtgtcagagacctggaacactactgtgtcctggcaccccctcagccgctttcttgcctatggtatctcccaggtgccaggtgccccctaccctgcacaccaagagccacgctgggagagagtgctgccagccgagcacccgagcgcctcgacccgtcccacctgattgcaccggctctaaggcaaacctcaaagaatgcgctcactgtgaaggacagtagttagctgtgtccaaatctgtctgttctgctagagggaagctcctgggagagggaccatggagggcaggactgcgcctcactcccacctttgcatcttcagagcctgcaccgtgtgcacatagcccctcatcacagggcttaatcggtttgctgaatgaatacatgatcttcctatttgctgagagccataaatcaccagctatagaagtggtggccccagtagccgttgcattatagcatcccagggccaaagagaacaccagaagacccttaattttacaggcagagttgcctcaggccaatgactggctccaactctcagattttttttttttttttgagacggagtttcgctcttgtttcccaggctggagtgtaatggtgcgatctctgctcactgcaaccttcgccctctgggttcaagtgattctcctgcctcagcctccccagtagctgggatcacaggcatgcgccaccatgcctggctaattttgtatttttagtagagacggggtttcaccatgttggccaggctggtctcaaactcctgacctcaagtgatccacctgccttggcctctcaaagtgctgggattacaggcatgagccaccacacctagactcaaagacttttttaaaatgaggtgtattcctcagctgcccttagctttcctcccattgccacctttacagacactaaagaattttgtccagactcttcctggtgtacataaattccacttccctttgttttcctctcacaggaagtacaaaaacagcagctcattcttgcatagaaaagaattctcctcccaaaaaagaagctcccaggttctagagagaaagctttgaggccctcagtttaagccattctgccttctgcagtgtctggggaaagctgctgtcgggcccaactctctcctagaggcaccttgaggtgtggagcttggctccgaagccaggcggggagccagagggagggcgcctgcaacctgcgaagcagtttcttaagtgatcatttgcatacctaaaaattcactgttcatggtaacaaattccttttaaaccaccttctgcactgataacaaatctatgttttgccaaggtgaggggagaggcgatcagctgccgggggccacactccgaagtgcgaacagaatctgaagcaccctctcacgggaaatgccggcatctcactgacctgattctgagcaagcaagagggcgctggattgtcccactctttgaagctcaaaatgggcttctgtaagcaccgaacgcacgtcacctaatttatctctcatcacaccctgtgagcaggtgccattgtcatcatcccccctttagagacaggcgaattccgcacccccataaaacgactcactcaaggtcattatcagccctacatctataactcacggactcgtgtctagagagttctgcctggctgattttctctgttcttctaactactccacaactaaatgtttcacaaagccatttcccccccaaatatttatgttctcaaatgtttattgcctctctatcatgatcaagattttatgagcactctatatcagttgtgaattaaatacataatttcggaatcatcgcattccagtttggtgctacatttgtctctattacaccgcagcagttgccgtgggcacccgacagatgacaacggaatgcgtgtgtccaggggcagccagagtgactgacatttcaatccagaagctgccacggggacctggtgattcccaccgttagcgggagagaagcttccacagctcaccgggatggtcagagggttccggagcaggacaaggctaggatgggctccccccgtcaccctcactgcaccaacgaggccgtgtccaacccgctggcctctggggaaggagggcccgccatctcacggcaggtgaagaagacaaggagaaaaagaggccatttttttcctctgatgagcagtacccactctcttatagaacaatccgggctatgcctgggggcctactggttaatcccatcctgtatgggaaatacagaaagaatatcgagcctggaacaaaactgctacaatttattactccctcacatttacctgtatgcactacctgactgaccctcacagcaacttcacacaatgtggactgctaattccactttgcaagtgaagaaactgaggctccgaaaggcggcaaccgcagaggtggatctggttcctgtttccaggcctttgccccttctgttccctcttgtggccagccccccgaaacactaaaaatggaaataactgtcattactgaaatactctatctgtctatcaaaatagaactgccgtgggtaatatagccattcctgaaagaaaacatttagggatattttaaatccatcattgatcctaagggagggaaaaaaaaggtccctaaaccttaagtttcatgatgataaacacttccacagcttgagcacgaggagggcaattccactgaactgggccactaacttgggcagggctgcagttttgatggctctgggggctgtccctcacatcgctgtcctgatgtcctcatggtctgccatgtggcatcacccagcttagatgaagcctttgtttcttggacgtttccgtcatttccaaagcatccatcactttcagtcatccaattctttattgccaccagtagaattatgagctcttgggcactttggtggcacccattgaaaacagaagtgcaactacagttcccttccaggcttttaatctggagaaacagtcacacgaatacgcggagccacacatacggcatgtttattacagaaccatttgcaaagggaaagaaagaaaaaagtctaaatgctcttcagcagggcttcctactcatccatatcctcatcagtacttggtttggacagacttaatgtttgacaagctggcaggaacaaaacaatgtaccattatgatttaaattcgtattttccattttctttttttttgtttgtttgtttatgttttttgagacagggtctggctctgtcacccaggctggagtgcaatggtgcgatctcggctcactgcaacctctgcttccctggttcaaatgattctcttgcctcagcttcccaggtagctgggattacaggcctgtgccaccaggcctggctaattttttttttttctgcatttttagtagagatggtttttcgccatgttgcctagtctggtctctaactcctgagctcaagtgatccgcctgcctcagcttcccaaagtgtggggattacaggcatgagccaccgcattttccattttctaatgaggtttagcaactttttctgttttttggcccttgtgttttttcttttgtgaaatccatgttcacgtcttaaaaaaataaaacaaaacagccttactgagatataattcacacaccataaaattcacttatttacagtgtacagttccagccgggcatgacagcgcatgcctgtaatcccaggactttgggaggctgaggtgggaggatcgcttgagccccagagttcaagaccaggcttggcaaaacggcaaaaccctgtctctacaaaaaaatacaaaaattagcctggtgtggtggtgtgttgtagtcccagctattacggaggccaaggtgggaggactgcttgaacctgggaggtcgaggctgcaatgagctgtgatcacgccactgcactccagcctgagggacacagtgagacctggtctcaaaaaaaaaaaaaaaaaaaaatagaaatgtacaattccacaggttttagcacactcccagaattctatgatctgttcctgatttttctgcccatttttatattaagcatactttatctcattcatttataggagctctttataaattctggatactaactctgttttggttgcaactagcctatcccagattgagtcttttcattcttcagatgaatgcctttggctgaataaaagttctcaattttaatgtagtcaaatttatttattttcttttgttgtttacgctctttgggtcttattttaggaagacttctgtatcccaagatcataagatagtttcgtatatgttcttctacaaggttttacagttttgtctttcacatttaagcttttaaactacctggaattgattgttacatatatggggcaagtagctgtcgaaggtaattttttcccacatgggtacccagttgcgcagcatcatttattggaaagtccatctcttccccctgatccgtggtgccacccctgtcattatcaagtgtgagtgtttccgggctctgtgttctgtgtcactggttagtagatctaatttagtgctaacacctcaatgtcctaatggttttaaaataaatagatatttgagagggcaagtcctcccactttgtctttcttcgggaataacttgataaatttttaactctttgctcttctatgtaaatgcagaatgagcacagcaagttgcatcaaaaagaaccactaccaacaatttggaattttaattctgattccactggatctatgatcaatttgggaaggggtgacatctttataatattagcgtccctaaccatgaacgagacattgcctccctcttagggattcttacatgccttttaataaacttacacagtttttccaataaagggcttatacatctttcattgtgtttatttcagtgtacacttttcttctgctatacgttgttaatttttttttttttggagatggggtcttgctgtgttgcccaggctgcagtgcagtggaatgattatagctcactgcagccctgactcctgggtttaagtgatcctcccacctcagtctcccagtagctgagattacaggctcaagctgctgtgcctggccattgttgttgattattatcttagttttacattttccaactctctgttgccaaagaaagtgtaaataatctttggatctttaattattgatcttttagttggtaaccttgctaaactctcactaaaactattatgtactccataaattctttggggctttcttaatgtagataatcataacacctgccaataatgacttttggtccttccatcccaagtcctagaggttttatttacttttcttgtctttactgcactgtttaataatgtttcatagaaatgatgatgggggaatccttgtcttatgcttgattttaaagggcatgcttctaacatttcaccactaagacctatggttgctatagtttgggaaggtatcttttatcaggttaaggaaattcccttcagtttatagctaagaattttaaaatcatgaatagatatttaattttatccaatgctttgtcttcatctattgaaatagctatatctctttttctttaatttcttattattgtgaattcaagtaatagcttttctaaagttgaatcatccttgaataccctaatacacaattggattggatttgctaatattttgtttaggattgtggcaactatatttacgaataacattggcctgtaatttttcttatttatattatctttgggtttcacattaagactttattaatcttatgaaatgtattgtgatgtgttccctctttttctttttctgttttctgaaaagagtttgttcacaatgggaataatcaattccttgaatactgtggtagatttcacctgtaaaaggcatctgggcctagtgtttaagggaggggaacaattcatttttattattcaatttatttaatagttatgggactttggattttctatttcttttttcttttcttttcttttctttttttttttttttgagacagggtctcactcagtcacccaggctggagtgcagtggcacaatcttggctgccacctctgcctcccgggttcaagcaattctcatgcctcagccactcgagtagctgggattagaggcatgtgccaccatgctcggctaattttggtatttttagtagagacagggtttcgccatgttggcaagtctggtctcaaactcctggcttcacgtatctgcccacctcagcttcccaaagtgctgggattacaagcatgagccgctgcacctggcctctatttcttcttatgtcactattcataagattttttttcctatgaatgtatctgttttatctatgtttccaaatgtattgccataaagttgtttgtaatatttttcctatccttgtaatctgttatatttatgttactatatttattatcaaaatgtgtttcatcctctttttcatttcaaatatgtcaatctgttctttctttcctttctttcttcctccctttttctcttcttccctccctccctccttctctctctctccctctctctctctttctttcttcttttcttttcttcctctctctctctcttttgttttctttagagacagagtcttgttctgtagctcaggctggagtgcagtggtgcaatctcagctcactgcaaccttcacctccccagttcaagcaattcttgtgtctcagcctcccgagtagctgagactacagctgcatgccaccatacctggctaatttttgtatttttagtagaaatggggttttaccatgttggccaggctggtctcgaactcctggccataagtgatctgcccaccttggcctcccaaagtgctaggattacaggaatgagccactgcgcctggccattctttcttttttaattgatcaatattgctagagatttgtcggtttattaattttgccaaggaatccacttttgctctacccaagctctgttaactattccattggtttctgttctctctccagctactctttgagtttagtaattttttaacctaggtcagcggcttagatcattaattttcaactgttcttcttttgagatttatttttcactgaataccatttatgttccttcaatgtgtgactcctttcaattaaaaaatcaaagtagatgatgttggagtgaccccaggaagatgactagctagaggcctctagtcagctctcccttccacaaagacggccaaacagtgaataaacaactatatttaaatgaaaataaatacaggagtgagtcctggagttcatcaaaggagtaacagaaaccctggtgagcaaagaaactctggatagccacatagaaaacggaaggaaacaatcccagcactttgggaggctgaggcgggcggatcacctgaggtcaggagttccagaccagcctggccaatatggagaaaccctgtctctactaaaaatacaaaaattagtcaggggtggtggtgcatgtctgtaattccagctacttgcacccaggaggcgaagtttgcatgagctgagattgtgccactgcactccagcctgggtgacagagcgagactctatctcaaaagaaaaagaaaaagaaaagaaaaaggaaggaaacaacaggactccactgcccatcctccagccagagtcagccaggaaccaggaggaacgtcttcctacagcgaaaaggtagaaaagaggattccagcagctcccaccaccctttggacacctgctcaccactggggtcctcacaggccctatgcccatgcagagagctgtctagtatctacacagctgtgctcccctagagaaggaggtgacacagtaccctgccactgtggccagccggctgctgtatgacaccatcttgaagctggagctaccgctggagtgtgccttgcttttgggggaaagtcacaacaaattttaaagaattgatatcatatcaagtaccttttgtgaccacaatggcataaaactagaaatcaataacaagaggaacttttgaaactgtacaaatacatgcagattaaacaacatgctcctgaatgaccaatgggtcaatgaagaaattaaggaggaaattaaaaaatttcttgaaacaaaggaaaatagaaacacacactcttcaattaagtttagcctaaggctgccatcttacatattttaagtttggcctaaaggttgctttatacacagtaagctgtaatctaactagatgcgtaaacagactgtaacttatttttgtacctatcaccaagttttggccaactaaggcagccaactgttcaaaccgtattcaaataaggcaaatgccaagctataatcaatccagttgtttttgtacctcgtttccatcttctgtatgtcacatcattttcctttttctgtctacaaatccactccacccacttggcagcgctggtgtcattctgagcctgttctggtttggggggctgcccaattcatgaattgttctttgcttaattaaagtctgctgaatttaatttgtctaaagtttttcttttaacaatcccaaagcctacagggtacagcaaatgcagtattaaaagggaagtttatagtgataaacaccaacatcaaaaaaagtaggaagatttcaaataacctaatgatgcatttcaaggaactagaaaagcaaaaactaacccaaccccacatgagtacaagaaaataaataataaagatcagagcaggctaggagcaatggctcatgcctgcaatcctgtcctagcattttgggaggccaaggtgggtgggttgcttgagtccaaaagtttaagaccagcctaggcaacatggtgaaaccctgtctctactaaaaaataatttaaaaaattatctgggtgtgttggtgtgcacctatagtcctagctactcaggaggctgtggtgggacaatcacttgagcctgggaggtagacgttgcagtgagctgagatcacaccactgcactccagcctggacaacagagcaagactctgtctcaaaaacacaaaaacaaaaacaaaaaacaaaaaaacaagatcagggcagaaataaaactaaaagaaaaatacaaagatcaacaaaattaagtcagtttttaacaaaatcaattagcttgattaacaagaaaaaaacagaaaagacccaaataaatcagcaacaaaaaaggacacattacaactggtaccacagatatacaaaggctcattagagactattatgaacaactatgcaccaacaaactggaaaatctaacagaaatgaataaattcctggacacatacaacctaccaagatagaatcagaagaaatagtaaaactgaacaaaccaattatgagtgacaagattgaatcagtaataaaaagtctcccatcacagaaaagcccaggacttgatggcttcactgctgaattctaccagacatttaaagaagagctaactgatagtaatggccaaaaccacaattccttttgcaccaacctaataccatttcttctcaaacttttctacaaaatagaagaggaggtaattcatccaaatgcattctatgaggccagcattactctaataccaaggccagacaaagatacagcaaaaaaagaaaactataggccaacatccttgatggacacagaagcaaaaatcctcgacaaaatactaacaaactgaatccagcagcacattaaaaagatcattcaccagctgggcgtggtggctcacgtctgtaatcccagcactttgggaggccaaggcgggcagattgcctgagttcaggagtttgagaccagcctgggcaacacggtgaaaccgcatctctactaaaatgcaaaaaattagctgggcgtggtggcacgcacttgtagtcccagctactcgggaggctgaggcgggagagttgcttgagcccagggggcggaggttgtagtgagccaagatcatgccactgcattccagcctgggcaacagagcgagactccatttcaaaaaaaaaaaaaaaaaaaaaagagaattcaccataatcatgtggtgcatctcagggatgcaaagatggttcgatatatgcaaatcaataaatgcaatagatcacaccaacagaatgaaagacagaaaccacacgatcatcttaatagatgcagaaaaatcatttgataaaattcaacatcccttcttgataaaaacccttaacaagctggggacagtggtgcacacctgtagccccagctactcgggaggctgaggtgggaggatcacttgagccctggagttcaagaccagcatggccaacatagcaagatgagaccctgtctctaaaataaacaagcaaaacaacaacaacaaaaccctcaacgaacaatgtatagaaggagtatataccttaacacaataaagctcatatatatggcaaaccgatatctaactttatactgaataggaaaaagttgaaagcttttcctctaataactggaataaaacaagtatgcccactctcatcgctcttattcaatacattactgtaagtccttgccagagcaattagacacaaaaaagaaataaaggtcatccaaattggaaaggaggaagtcaaattatccctgtttgcagatagcatgattttgcatataggaaaccctaaaatgctctaccaaaaaactctttgaactgataaacacatttaataaagttgcaaaagacaaaattaacatacaaaaaattagtagcatttctatacaccaagaataaactggtggaaaaagaaatcaagaaagcaatcccaattaccattgttacaaaacaatacctaagaataaattttctttttgagacaggatcttgctctgttgctgaagctggagtgcagtggtgtgatcatggcaaactgcagtcttaacctcccaggttcaagcaatcctcccacctcagcctcctgagtagctggaacaacaaatgtgctccaacatgcctggctgatttatttttatttttagtggagatgaggtctctctgtgttgcccagactggtctcaaactcctgggctcaagcaatcctcctgccttggcctcccaaaatgttggaattacaggtgtgatccactgtgcctgacctcctaagaataaatttaaccaaggaagtaaaaggtctctacaaggaaagctataaaacactggtgaaagaaattaaagaggtcatacacacaaaaattggaaagacattccatgttcatggattggaagaattaatattgtgaaagtgaccatactaccaaaagcaatctacagattcaacataatccctatcaaaataccaatgaaattcttcacagaaatagaaaaaaaaaacttaaaatttatatgaactatggaacattccaaatagccaaaacaattttgagcaaaaagaacaaagctggaggcatcaaatatactacaaagctatagtaaccaaaatagtatggtactgtcataaaaacagacacatagaccagtggaacagaatagaaatccataaataagtccatgtatttatagccactgacttttgacaaaggtgctaagaacattcagtggagaaggggcagtctcttcaataaatggagctgggaaaactggatatatctgcatgcagaaaaatgaaactagatctctatctctcctcatagacaaaaatcaaatcaaaatagattgaagacttaaacaaaaggcccaaacctataaaactactaaaagaaaacatgaggaaacacttcaggacattggtctgggcaaatatttttttggtaagagcttaaaggacaggcaacaaaaacaaaaatagacaaatggggcttacatcaagctaaaaagcttctgcatagcgaaggaaacaacagagtgaagagacaacctatggaatcaaaggaagtatttgtaaactatccatccagacagagattagcagtcagaatacacaggaactcaatagcaaagccaattaaaaaatgggcaaatgatctgaataaacatttctcaaaagaagatatacgaatggccaacaggcatatgaaaataaatgttcaacatcacaaatatcatggaaatgcaaattaaaaccacaattagatatcatctcaccccagttaaaatagctattagcaaaaattgaaaaaaaaaagatgctggtgaagatgtggagaaagtggaatgctagtactttgttagcggggctgtaaattagtgcagctacttcggaaaacagtatggaggttctgcaaaaactaaaaatagatctgtcatgtgatcccacaattccactgtgggatgtgtatcaaaaagaaagaaacttagtatatctaagagatatctgcatgcccatgtttactgcagcactactcacaatagccaagatatggaatcaacctaagtgtccatccacgaattaatggataaagaaaatgtggtatatatacacaatgaagtactattcagccataaaaagaatgaaattctgtcatttacagtaacacagatgaaaccagaggtcattatggtaagtgaaataagccaggcacagaaagaaaaatatggcatgttctcactcatatgtgggagctaaaaaagttgatctcatggaggtagagagtggaatgatggttaccagaggctgggaggggccaggggaggtgaagagaggttggttactgggcaagaaaatacagttagatagaaggaataagttccagtgtttgatagcacagtagggggactatggttaacaataatttattgcatatttcaaaatagccagaagagatttgaaatgttcccaaaataaagaaatgatagatgtttaaggtgacggacatcttaaatatcctaacatgatcatcgcacgttatatgcatgtaccgaaatatcacatgtaccctcatgaatatgtaccattattatctaccaataaaaaatcaaaatcattaactttttaatttttttttttttttgagacggagtttcgctcttgttgcccaggctgaagtgcaatggcgccatctcagctcattgcaacctccgcctcctgggttcaagtgatgctcctgcctcagtctcccaagtagctgggattacaggcatgcgccaccatgcccagctaattttgtatttttagtagagacggggtttctccatgtttgtcaggctgatctcaaactactgacctcaggtgatctgcccacctcagcctccccaagtgctgggattacaggcgtgagccaccgtgccggccaactttttaattgtttatgccttttggatcagcaattccatttctatgaattttccccaaggaaatgatcaaaacatatgcaaaaacaaatacaaatgcatatgtgtgtgtatatatatgaatgctagttgttgcattgtaatagaaaaaacaggaaacacatgtctgctaacagagggtatttaaatacattataatacatctggacagtctcatgctatgcaaacacctagtgagctgtatctttatgcagtgatagggaaagatgtccataatattttattaagtgaaaaagcaagttacagaaggatatatgcaagattttatttgtcgttaaaaatctccatgttttaaaacccactggaagatgagtcccagccacaccactgcaaggcttccttaattggtccaatcatctatttattagagtgagtgcaatacagttcctgcccgcatggggggaaacaggctgggaggagggccaggggcaagtaagtgctaggaggggaaatgggagggggctgggcgggcactgtggggaggggcaggggttcccaaggcaacgtcgaaatctccaaatacagtgggcctgacggggatgacagagaggctgaagagacagagccgtcctgcacagtccaggcaccaccctgccctgccactgcctggcgggcatcttgagctccagacccttagcctctccgggccccccagttttttccgggtaagagactcgaactgatgctctctaaggattcttcaagctctgaaattctctgctgacatttgccagcagcaaggttgactcgaatctgaaacctctggggaaagtgggggcctctcccagaatggaaccctctctgaacactttcccgggagggaccttagactgtgctgcctgttgccagcgtcgcaggcaggaggagcgcagtcactatgggtggggtgagtgcatgggggagggagtgaaagagcaaatgtccaaggaagggcataagagaagggctccagcaagaatgcaaaggaagatttgtctaaaatggcttttcaaggcggtcatgagcttgcctctaacccagcaaagcgtgtggaagaaacatcggcagtgagggctcccatctctcatttctcaaagagccgagactttcagcgaggccacttgccattcctggtaggtaatcagatcgctgttaattaataaagctgtcaggtggctcgtcctctctggtcattagtatcctttcagaaagagaatcctgccatcaccgccttgtccgcccctccgcttgccagcaattaacttaatgctatgcaaatgagaggctcttctcatcattagcttatagccacgaatgttaatcgcataattgggtcttcaacagggtaattagacacgatttcctccattagtcttacaaggctaattattgttgagcggagagggggactgctcccagggctccaggcgaagaggggcatctggttaaagcgaattcgggcgcatcgtccgccaggtaaaaacagcagtcgcgatccattgtcacagcccactgtccccacccatcgtggggaccgggctagggagggaaacggaaccaggggaaggcctgggggggtcacactcgtgccccttgcctgggtcctgggatgcagacaacgtggcatttaaaagtgaaagcggaaacaaacagcagccccgccagcccgggcccggaggcccagccccgcgccaagggccacccctcggcgcgctcagcttccctgggcctctgctgcttcctcagtgccatgaggaccgcgctcgatggcgtccaggggcctctgggtttgactttcatggctatgaatctcggaatgaataaagagcccagaacgctggctggggtagggggtggggcaggggcgaggggacaccctgtggaggagcgggctgggagcgcgggggatgcccctcgccctgcacgcgcgccctgcccctggctgtaacctgagcagcccgcgtgagggtcagtggtgacttccgggattgaattggctgggaagccggtcccatttcaacagagacctggggcagcgcggtgggcagcgggctgggccgagatcgagaccgggacaaggcagggaagagcgggatgggtcggccccttcaaggggagccctggggcgcagtgtggggcggtcttgctccctgttgacccccattccccctcccctggatccaggaacccagtgggctctggaagcagctgctgagtgcacggcagaccccctggcatggggttacaccttctctcaggcccagcggtgtgggcctccccagtcagggagatgcttcccccatctcatctcagtggggagggagcagctggtggcctcggcaaacgcagcacaggagatgggagggtctggctgagcagggggcctcaggaggcctctgggaagccagcagggcaggtgtggacttagtgccagggtgacctgaagactctgcgctcagcggctcagagcacaggagtccagggactccgtctcagtccgagtccgtctccactgccatgatgtgctgtgtgatgagggcaagacactcagcctcttggagcctcagtttcctcagctgaaaggttcgggtgatgcaccctttcctggtcttgctggaaggactaggagggaagaggtaggccaggtgcacagcccagggcctggccctcctgcccacaggagacaagagactatggaggaaagtgctatggcagatggtggtcaggcttacactgtgagaattatgtccctgtcaacagaacgggccaggaatcatgcacatggcagccctctctggatgtttttacgagattctgtttatgaaaatgtgtcgccttccctggatcgtacaatcctccatctttatatgcttaagcccctaccacaggctctcaataaggccattaaggggtccttcatggactgaaagggcgcctcttgtaaagaaacaaaccccaaggtgtcacttgattgaaatgtgaaggcagaatgaaggtaagctggagagtactgggtctccatccatctagcatgttctgactgcaattcccttcaaaaggctcaaggctcccaccttgttatggcggtgtggctccattatgaatggccagggccattgacaagcagcgtcgtgtggtgtgaggtcaccagaggggaaaggctaggacggagcttcctttcagagcctgtgtatcagtctgttttcacgctgctaataaaaacacacctgagactgggtaatttatacaggaaagaggattaatggactgacagttccacatggctggggaggcctcacaatcatggcgtaaggcaaggaggagcaagtcacatcttatatggatggcagcaggcaaagcgagagaacttgtgcaggggaactcccccttaaaaaaaccatcagatctcatgagacttattcactatcacaacaacagcatgggaaggacctgcccccatgattcaattacctcccaccaggtccctcccacaacacgtgggaattcaagatgagatttgggtggggacacagccaaaccatatcaccccagaatgctcctgccaccaccatcaatgagaggagttgctctttgagagctcactgggtgttagactctggtgattcccaaatttttcttcctgaactaccagactcatagcccgctgcagatgttgttagggttgaattgtgttccacaaaattcacctgtgaagccctcacccccagaacctcagaaggtgactgtatttgaacacagggcctttaaagaggtggttaagttaaaagggccctaaaaggtgggccccaatccaatctgactggagtccttctaagaggaggaaatgtggacacgcagagaggcacccagggcacacgtgccatgtgaggatgcagtgagaggcctcagaagaaaccaaacctgctggcaccttgatcttgggcttccagcctccaggactctgaagaaataaacttctgttaagatacctcatctatggtacattgctgtggcagccccagcaaaccagtagatttctaagaggcatctcaagcttatcatgcccaaaactgagctagtggtccctcctcaaccccattcctccagcctcctcctctggtcatcacaaggccagtccattcttcctgctgccccagcaagcacctgagctctctgcaacgcctctctctctcacatgtcctacatccagtgtgatagcaaatcaatggtaccaattctaccttcaaaagacttctcaccacctccacagctaccaccctggtccaggcctctggcacctctcacctggattactgccaacagccctatacctggcctcccagctgctaccttgtccccctgcctacagccctttctccacccactaggtatctttttacaacatcagcgggatcccatctgtcatttgctcaagccccacacagtggctcccacatcactccaaggaaaagccgaattccttcaaggtctatggtctcctgtgacctctgacacctcacctgcgagtctctccctgatctatggccaatggcctccttgatgttgctcagagttgccaggcacattcctaactcagggcctttgcactgtagttccaggcctggaccactcttccctacatctgtccatggctcattccctcactccatataagcctctgctcaagcatcatcagaaaggccttccctgatggccctctataaacataccaccctgtcctctccagccttcctggatggccctctataaacacaccaccctgtcctctcccttccagctgcccgtcttccctattcccctttatcctgttttattctccatagcacacaacatattatgcatctggtgtttatagactttctcactccaaccagaatgtaagacacctgaagcgtcttaggttttgtttccttttgagtcccaagaactcaagtagtgcctgcatgcaatcgatgttccacaaatatttgttgcctaactgaataaagtcattgccatgttacatgggaggaaaccatagttcagagtgacaaataccctgaccagcatcacacagcccatagatggcaaagccaggattccaacccagttgctgacttcagaacctctttcttaaccactgtcctattatgctgcttcccatcacgagaaaaatatgtaaagtcttatggaggtgcagggcaagaagaggcatcaggggaggcttcctggagcaggtggcatttgagctaagacttgtaaaaagataagatttgtatgaaatcccatggtgttctgaaagaagaaacaccatgagtaaaaactccgtgtttaggaaacaggaagtgggtaggtgtgctaaggtgtaggggggagacgggagtggtagataggaaagagaggaagcatggggcccccctcttcccttggcttctggatgctccccatttctccttctccccactccaccttctactctgggaggggctcctggcctggcagaccttattgggatgcatgaagccttgccctatgacctagaatccacgctcctgagacaggcccaggagagaaaaggaggcacaatgccagcgcccctggatggacactgtctcgtggccagaatggggtgggggtggctctgaccctcctgctcatgggggggttgggggtggtctggaatctgcagaaatctcaaagccaacaaggaggcgatgcctggagtcttacaatctcataaaaagtaaggctgcacttctatttgtggaagacttttcttaaaagtttttttatatattaaataatttctgtgatatttaggaagaagagcttcaagcttttagacatctgccacctgaatctggcagaggctcaagcttttaaagcacagtgccgggttcagcagttcagcactttagttatgcctgtaaggaagatggaaaattgaagtacactctgatgtctcccgaagtcccctatgggtaaagaaaaacaaatatgatttctccaagtcatcttggtgtctctgtcctcttgcctttctctgggaaataaatttaagtgaacggtcgagcatcgcgcctgccaaaaatgggggcgtctccatcagagctcgattcaaatgccaactaccccgggctctgttctgttaaaggtcacctgtcattgtccacccgaggcatggagattgctttggagctctgatttccatggcggggaaggcatgtttatcttctccaatgtcttattcaccgctggcttaggccgaactgttaccggttgagtacaacccactgggcccctaataagagcttggaatccacaggagggaaagaaattgagatgcgctttgccaatgaagagttgtaaaccttaaaggtaggcaaagagaagtcttttcaggaggggaaatttcctgcctgtgaaggttctcagacactacagcaggaaatggagaacagtcatccctttgtctccaaaggacatgtttacccagaatgctgtgctgagagcaggggatggcaaagggaccctggaaacctctccctgacctccaagagtcagcaggaaagttgaaccagcaatgcaggctggactggggggctcttagaaagctcttaggaaaaaatgttaagtggtaaataaactgagtttcagtatactgcagtgagactgtttgtgtctgtttattttatttttatttccttttttatttttttgagacggagtctcactatcacccatgctggagtgcagtggcgcaaccttggctcactgcaatttccacctcctggattcaagcgattctcctgcctcagcctcccaagtagctggaattacaggcgtgcaccaccatgcccggctaatttttgtatttttagtacagatggggttttgccatgttggccagtctggtctcgaaccactgacctcaagtgatctgcccgcctcagcctccgcctcccaaagtgctgggattacaggcatgagccactgtgcctggcctcatgtctgttttaaactagcaaaattactcaccaagaaaagaccacacagagcccttgctatatggcatgaccccatctcttcctcaagattaagctccctgatagaacaggccatctctccatggctccctggaagcttcttcccacctaccccaggtaccatgcaatgctccctcccaatcctcggctgcctcttggggacagcacagccatgcctgcggttgcctaggcactctctctgcagaaattcactgtatttttatactcagaaaaatccatgaggctgcaggcagagttcacaggttatgtacattttttgatgtcactgcttcaaaagtaattgctcttatgctctcaaacacagacaacacacctagcaacaggctgtcataaactaagttttaacccgagaaagcagcagcaccggcctctcctgcatttgcccacatcatcctcactggactgcctcttacacaaacattggaaataagtggtaaaatgtcaatggtccccaggcaggaaaataatgggagaactttcctttttccactccagttctgagtttatttactgagagattaaaatgctacaactctaggggtggtgggctgctggcctatcaccaccattactggccacaaccttgggctcgagcccaggggtgcacctccttcttaactgcaggccggatgacccagccaccgcctcccttctgacctcaaaggaggctcagggagcaccctgcaggcctgggccaaattccgcccacagggtagcactcgcttttgctacaacaaagcacgaggcctgctctgagagtcccgagagtcctgttggtcagagtgtgctgatgctgagtgcaagtggctgtgagaagggtggtggtgaccaagctggtggcacaggaaggcagcctgctgtgggggcggtggatccaaaagcatggatgaggccgtccctcaaacagctgtgccagcagagctctgagagtgctgcggggccgccacgctgcaggatggaagggctggaggatggaggacctttgcttgagctttaatctcttcaaggccacctccatgagtgtgcctcgatcccaaaagatgaagagctcagagttaggacaggccagtgccttctcatcccaccccaagacaggagaagacgattcacagggctctcttcccccagctttgaagtcatggctaaaaactcttgattccccttcacgggcaatttactaagcccccaccaaccacttccttatccggcttccacaggccatacttggggccaagttctagacaacctgggacagcctctgtgctctggagcctccaaaattatttaaattagccacattagacccctggttccatgggggtctcagatatgagtctgatttcatccttgtctccttgcaagatcatcctcctgccccgcgtgtcacctggtggataaggaactgcctttctccaactctaccccgcaaagccagcccaggggaagcaggctgctcagaggggccagccacagccacaaaatcttgcgactggtattttggtgaggaattgggttgaacgtacttctcagaagctctgatctccacagaaaggcacagagccctcaaaatattaggaataaatatggtcacacgggtggagcccctattggtgccagttgtgcccagtgcctccccgcatcatcccattgaatcctctcacctgatgccccaaatcccactgtccctgatttttagtcaaggaaacggaggtgcagagaagctaagaacttgcccaagtagaagtagatcagagacgagctgcttggactccacaccggtgttccttgcccctgctgcctccctggctacagactgagcctggctctctagcaaactcagatttcaactttgaatctgttgacaacattatctcagttgtacagagtattttccaattcatcattcccacccatacatattttcccagcaaatatgtccattagcccagcaaatggtgggcggggctactactccctttgatggttaaggagacttgaggcttagaaagggtaagtagccgcctgtagacaacttggccagtaaagcagtcaagcagggctgagggaaacagttgtgaactatcaggaagctctgcgagcaaggaaggaaacttggggtgcaagagagatcgctgccaaatgtttaaagaaagagaagagcccagaaaaggcaaggctgtgggtcccacccccaacacacgccccactttctttttcacccttgtccaccgacactgtggaaacaatggccattccaccaaagctgcccgatttgaggcaaaaacctcaatccccaagtggacctctgtctcgaggtgcgaaggagcgcagcaggcctttgctgcatcacggcccatgcgacaaaatcagaatgatgtcaggtcctgttgcagtcagctgcatgggggcttccgttaggatgggccttctgttaggcggaggctcgcagcaaacccgtctttaagaaagagctttcttccaagagaaaaggcaccatggcgcacacagtcaatgatatgtattccagcccatgtctggtaaactctcggatgatggcagcaaggcagggtcacccgggttctattagctcaattaatgaggagtaagataaggctaacaccctgctcgtcgggaggctcaggcccagagctgcagtaatggagttattaaccttcgtcagccactggattttgctgctgattccaactccatttcctagttcaggcctccattaatgggctgtttattatccatagtccgcataaggatcagctgcagaaatagtgcttcctggaaggacccgtgataatgaaagagagagagagtggggcgggcaagaaaccctctctactttgcattttaatttttctttggtcctactgctgtcctcttaagaaattacagcatccttctcactttggaccatgttagaaatgacaaagtcattatccaagggtttcaatgtgttgtcccccaaaagaaattgtcatacggaaataaattacatcaaattagggagctctggcctataaactatatgccaatctggtttttaatttcataatgtaccaccatattccatcgtttaaaattggacataattgaaacaaaaaaatcaaaaccacatttagcagaataattttataaacattggtaaatgccctgattaaaaatttccagtttgcttcagtttgaattgaaaaaaaaaaaatttccagttttcttggctcgatggggtcctgaacaaaagggcaattttgtctttgactattttggggtcattcgccgcatgtgttaccagaagaacaggctaccttccccacttccaagccaatgagaagaacaggctaccttccccacttccaagccaatgagtgtctttaaaatgtcttccatagataaggaaagcaagcaggtcaccattagagaaaaaatatttttaaaattatttgtaccaacccatagtgagtagatgcagcaaatactctttgagggtcatcccttcaatatttgccatcttagcctctttgtattgagcaggaattcagcgtcacatggggaagtgtcatagtaaatgtgtttacacttcttaacatatagacaaatctgtagcatcctatttgggggctgtgtgtgctttatttatttatgtatttattcattttcggagagacaaggtctccttctgtcacccaggctggagtgcaggggcacgatcatagctcactgcagcctctgattcctgggctcaagcaatcctcctacctcagcctcccaagtagctggaactacaggtgtgcaccaccatgcgcggcttagcgtgtaacttgttatgtgagaacaggcgagaagacaaactctcccctacacatttgaataagagtcggccctgacaggaggtactctgggcactcacgtgcagagcaggtcatagccattcacagtatccgtacagctctttcaagctatcaaccacatgcacacatcctccatctactctccagagcagtagtgctgtgaggttaaaagagtagagattattgtcccatttaacagataaggaaattgacgttaaatgtgtcttcttcaaaccagctagccaacagagaaggataaatgcaatcccattgcataaaggatagaatttaacagttcagagcaaagagttgggttcagggctggccccttccatggatcttacctggctatgtggcctggagcaaggacatggcttctctaacgctgactgccttttacctgagcaaacctcctttactgggctgttgaatggatggaatcacataggaaacaactgcataatcagcactcagtaaagaccagatatcatcattattactcttgttgtcaagataatgctgattatgaaggaggagggggcagaagagagaaggaggagggaaagggaagaagtgtcctcaatggacgtgatctgggaacaaagtgggaggggctgtttcacggcagtcagagaataaaaggagaatgaactgaaagatgaagaaggagaaagagaaaagcagagaggaagttgagaaaggcagagcagagatgccctgtgcaaagccatggcagttttgtcctcggaaatctaagaagaaagcttccagacctgaggggacaggcttggccccagcagactgcgctgagtgcggaagtgacagccccttgtgcctgggggtgggtgtctgccagcctccctcccctcggcagctctgttctctctggctttctggaggaaatgtctgtgtggaaggtctgtttagcaaaagccaacaacaacaactacaaacccagcaccaacggggagccatatgcaatgagaagagacctgtcactgcctttccagggacaactgaaaccctctgggctcctctggatgtgggacacacatacccatcttatttaaacaacaataatacataaaaattcagaaaccaccacatcctcaaaggaacctatatagcagtttccagtttgcacaaaatgacctggcacccaaatgagctaatcagaaatctcattcttgggtggtttcctgagagtcctaaaatgcagtccaatgaagagagaaaaagatactccagaaaacaacaccaagattaaaactccctgctaccattttgctgaatgtcattgccactgactcatctagaaccctccttttacatccttttccggggatttctgagatagcatgaccaagaccttgtgggggagggttaaggtcacagcttgccctgccccctccctccttgcagcacggagggaaaggaggatgcaaaaaaacagtgggtctcatacacggcaaacttcccaacatcaatcagaatcctatactctttctctgtagtaagcattaattttaaaagaaaatactgtgctacaagcttgcagcatgaaatgaattattttacagccaggcagagggcaggtttctggatgcagccatgaacatagttctttctttgtttctttctttctttctttttttttactattattattacgttttaacaaactttatagcccattttatttgttctgaaataactttttttccttcttttcgacagatcaattacttggtttgtttcccttactgtatgatgttggaatcaagagattgatactgctcagtggaatataatttagtattatgtgccatgggtttatgaggtaggagtcagacaaaacattgcatttgaacactacccatttattagctctaagaagagatttatatttgacaaggagacaatagctttgttttctgataagccaaagaggtctatttttgtgtccaatacactgagtagcttacccttccccgataactctatttactagtgtgaatatattttaataataaaattgatatatatgtaaatttattttaatctaatttcattgaaccttccttaaaaaaagagcctttgtagattttcatatctgaattatagatttctgtatcgtattcccagattgatttctaggctataattctgtcaagatttcctcctggtgtcaaaaacagcaacaccacagctagagtgttttataattggcatcacaaccgaaccagaattacagtcctgatagtcatcctggtgctaggtggattcattttagaatatttctctctttcttagcctgtatctgaacttgaaggtttacggctaagattactttctgagttaatcataaaaatgtttaactgaaagctaaggtgctggagatggaagagacagagatgagaaaggaggaaggaaaatataccttcaatgactacgaaaggatgatcaacagcagcatatgattaaatctacattgtaaatcaagattttttgttcctgcctgtccttcgccctagggtcaaataaattaaattggcattctttactaagtctttagaacgtgattttcactccgtggtgaacggaagagtgtttccttgcaaccctgccctaaatcaaatcggttcttgaatattcctcctgtgtgcttttcctccctgtgttggtcctgtagtactggtgcttgggctcggtaagtaaaacagtcatttttccccccaggcttcagaaaaccagcacaggattctctcccctgacctgttaatgacaccctgcccctgccttctttaaagtgattgttctgcattttccccagtgcgtttcatcttcacatagctgatgcgctcacaaagaagctatgcaggctgggagcagtggctcacgcctgtaatcccaacactttgggagcccagggcgggtggatcacctgaggtcaggagtttgacaccagcctgaccaacatggtgaaaccccgtctctactaaaaatacaaaattagctgggcatggtggcacgcgcctgtaatcctagctacttgggaggctgaggcaggagaatcacttgaatccggaaggcggaggttgtagtgagccaagatcgtgccattgcactccagcctgggcaacaagagcgaaattccgtctcaaaaaaaaaaacaaaaacagaagctatgcaactgatgctgtgacattaaccacgtctgtggcattaactatgttaggaagaacagagggtggacacttagcctttgggtactttggtccctggaatttcacaggaataacggcagtaaaacaggatgctcaggttaacactatcagatccccgctgccctgggcctaaacaggtttcagtcttccaatgggaagctctgtagcccaaactctagggatataattcagagttgaggagattctaactttgggaaaggcagaataatgcctgcccccaactccaagatgttcacctcttaattcccagattctgtgaataggttatcttaccaggaacaaggaactttgcagattggattaagttaaggactgtgttgatatggtaagattatctcaggttatctgggtaggcccaatctaatcacatggctccttaaaatctgagaccctttcccggcgctggtctcagggagacatgagtacagaggaaggatgggagttgcactacggcctctgaagatggtgggaggggttgtgagccaaggaatgtggaagcctctagaaggtggaagaggcaaggaaacggattttgccctagagcctccaggaaggaatgcagccctggcagtgccatgatttttagaactacagaatttgaagacaataaatttgtgttgttttaagccaccaagtcagtggtaatttatgatggcaatataggtaactaatatgccaactcacactattcttagacaaacaaccagcctattcaaaggtaaaggatttacagaatatatccatcttgggacccagttataggtgctaccaaaaaatggaaggaaaggggcataaaagttaaaaaaaaaaaaaaagagagagagacaatgaatacctgttagaaaatgaattactccaggaaacataagaacattttagataaaaccttaccagaatgttctaaataatttaaagagaatggactccatgatataggaagtgaaagaaaagatgatgagatttttaaaaaggagatgcaaagaaagctcacaaaatgaaggaaaaatgcctaaggggaaaagtaaaagcattatggaaacaaaaaaacaaatgaaaaacagcaagaaataaacacagcagaaaacagtcagttaccatgaaggtcagagtggagaaaataataccaaaaagagtaaggtaaaagccaccagcagaaaatccgaattatgaaaagctgatgataaatatctaacacacacataattggtcttactgaagaagaaaaccaagcaaatgaaccagaaaaatattaatatatctactggaagaaaatcatcctgaaatactgtaagtgaaagggttcctaatgtccagagaaaagtaataaggagaaccaagactgagctatggcctggtgattgtaaatgaacttaaagagaaagagaagggggtaggggacacagacagaggcagagagacagagagatctcccgaacacccaggcaaaagaaacacatccataggccgggcgcagtggctcatgcctgtaatcccagcactttgggaggttgagggggtggatcacctgaggtcaggagttcaagaccagcctggccaacatggtgaaaccctgtctctactaaaaatacaaaaagtagctgtgcatggtggcacacatctgtaatcccagctactcaggaggctgaggcaggagaatcgcttgaagtcaggaggggaaggttgcagggagctgagattgcgccattccggcctggatgacagagtgagactccatcaagaaagaaagaaagaaaaggaaggagggaaggaaggaagagagaaagaaagaaagagaaggaaagagaaacacatctggcaagatgtcagaggctgtgcagaagggatttggaacactgagggcgggggaggagcttggggagagaaagaaagaaacatgatcaaagaattctttgccagatgttgtttacaagtaaaaataacagaaagacattctcaagtatgcaaaaattcaggaagtttagtatctatgtaccctagctgaaaatgaatcaaagacataatccattcaaatgaaagataaaatcaaaattaataaatgaagaggttgaaatatataaacaactggtgttgaaatcttaatccagttttaaagagaataaaaactttgtaagtatagtaattatagttaaaaacagaatataattgttatatttctagaaagaaaagcttaatcaatactgattaaaaacaataatctgtgtataatagactggcacagaaaaatttcaggatatgtctgtccctggctcccccaaaatggagaatggctggagaagggggatgaggaggcagtacatgtgggatactctttttttttttttttttttagatggagtcttgctctgtcgcccaggctggaatgcagtggcgtgctctcggctcactgcaacctctgcctcccgggttcaagcagttccctgcctcagcctcctgagtagctgggactacaggcgcccaccaccatgcccggctaatttttgtatttttagtagagacagggttccaccatattgtccaggcaggtcttgaactctggacctcgtgatccacctgcctcggcctcccaaagtgctgggattacaggcgtgagccaccacgcccaaccgacatctttcatatgaaggggtcaagatattctgctgcatttcaaaatcaacaaactgagaaataaggtttaatcaagtcgtgttgaagagactattagaactataaacagattatcttctaaattaacggaagtggggcaggtaagaagctaacaataacaagaacaaaactcaaaacacatcccataaagaaaagatggaaaacaaaggaaaccataatgaagcacaaaataaagtaagaaaagcaaaaataagtgggatagactcaactattcaaggaaaaagtcatttcagattgaagaaaaaatatcaaacccaatttcattctgtccacagtgaagacaacatctacgggctccacccatgcatccagagcttccatatagctttttagttgtgtcatcaacaaaaaataagagaagcaaaatagttgaaagtaaaacttaggaacatgcaaatgtaacaaagaaatcagagtttgaattccagataaaaatggcttcttgaaacccgcaccagattttgtttcttccccaaatcccacagaaaaacgataggaaaggcactttgaaaacctaacctacaaggacagaaagaacagggaagaagaaggcaatcagacaaaggtttcgatgctggaaagcagacttgaaccagaggcaacgagctgaggcggcctcagaaagccaaatcctaaatcagtagtaggaaagctgagaatcaacctcatcttccccagaaaatcctcaaaaggctcaggcacaggtgccacctgggaactggtggctaaaataagggggcttggttgaaatttgtttcagaagagagtgagtcctagatcccttcctcactccacccagctgagtgaatgtctctcctccacttgggaagaaattaaacatttattctctagagaggataaaatacaggctctttgggctgaagaatgccaagcacagttgagagcctgagtctatggtaaacacaggggaattaagtaaaagtatgcaaactgcatgcagtatgtgagacccctcccctgcccttcccagtgtcctgcttctcccctggacccccagagagggggtcctggcagcaaggcctttaccctccagcaggagactgcatgagtcctctctggggaatcggagcagcccagaggaaaagatctaaagatgttgacacttggtgggagggttctgcacaaatggcccaattttatcaccccaatgataccaccctacagtgaagactaaacctgtgggctctttccatgcactcagagcttccaaatcgctttttagtctcccattcttagacgtgagcaaacaaccaagggtaattcaacatctaagggtaaaaaaagactctgctgagaaagaataagaccaagacaaacaaaaattcaatagaaactggttatgcagaaaggaaaaggaaaaaagcctatctccccatcctcctaacaaaatcaaatatgtcattaacattttcaagagataaaaaaaccatgaaataagatcaagaaactataaaaggaatattcagaaaacaaaaagctcttgaatattacagaaataaacaaacccaagagcagaaattagaattcaataaaaatgttggaagagaaagttgaggaaatctcccagaaagtagagccaaacaaaacaaaaagcagcaactgaccacacacacacatacacacaaaatacaagggaaaaaagatatttttacaacatttagaagcccagtcctgaagatccaatacccaaataacagcagtttcagagagaatagaaaaaaggggaaaaaatcattaacaaaataattcaagaaaatgtcccaggactgaaggacacaggtttcaagattaatttctggtacggtggagtaaatctgacctataccaaggatataatgaaatttcactgtgaaatttcagaaccctggagacaaaaggaagagcctacaaacttccacagaaagaaaaaagtcacgtatgaaggctcaggatcagattggcattggacttcttagcaacactggaaattcaaaattccacgggaaaatcatttccagcctatagtttctcacccagccaatctatccaacaagtatgaagatagaatagacactttcagatagaatagtagggcccccaaaatttacctcccatacactgtttctcaggaagttactgatagatgtgttcaaccaaaacaaggtagtaaaccaagaaaaaggaagccatgtgatatagaaataaaatatcgaatatgggagaggggtaaagagaatcttcagtgtagtagtgaaaggcaatcccaaaatgattgttgtgtacaggcataaagggtgacttcttcaatttagaacacatgtgtttccggtgtaacagtccactgcttttaaatcatctttttaacttgggaagcaactagaggttatgctttgtcaaatcaagggggtatataaaaggaagatgtgtaactcaggaagtagagactccaactcaaaagaaagccaaggggaattcctctgattatagtaaagaaaagcccctgatgatcaactatgcagtaagcctagaaaaaaaccagtccaaacagaagaggaatgggagtgaccaaaaaaaaaacaacaacctgaaactgacagattacacaatatgatggactttgtgggaaattgttctgaaaggctattatgagatgtggaaataattaactaataggtacaaagaaaactagacaagtgaaaaagcaagatgattattaacttcaggaaaatcaaaaagaaaggaaaggaaaaacaaaaaaaagctaacgccttccagctgagttagattccttaaagcaggtttcctggaaaaaccacaaaattgtatgcttgtatctcattagccagaacttagtgttgtggctccatatagctgtaaagaagactggaaaatgggatcttttattttcagacaccaaagtactcctctgaaaattgatcttttgttattgaggaggaaagttagaataaatgttggggtagataattagctgtctgtcactgatggtcactttcatcaagaatacatttcacaatgaacacatagctgacagaaacctttatgcactaaataacatagcaccaaaacacataaagccaaaactgtaggaaacacaataaaaattagtggcacaagatattcaaattatgttaatatatttaaagacaggggaaaggggtgattttctaagaagagaccaattgcacaagaaaagagagaaattcgaattgaccaaacaccctgaacaaaatcaatcaaattgttaacaagctacctctgccccaaagtgccagatccaaaaaaacagttactgcctgagttttaaaaactctctcagatatggagaaagaaagaaaatctacgaaattttcacatcactgatactaaagcctaacaaagcacaagaatgtggaaaaattctaatccatattatagatgcatattaatgcaaaaaaaaatgtagccaatacaatccaacagcatgttaatttccttgtgctgccaatatcatattatgacaaacttagctgcttaaagatactcaaatttggactgggtgcggtggctcacacctgtaatcccagcactttgggaggccgaggtgggtggatcacaaagtcaggagatcgagaccatcctggctaacacggtgaaaccccgtctctactaaaaatacaaaaaattagccaggcgtggtggcaggcacctgtagtcccagctacttgggaggctgaggcaggagaatggcgtgaacccgggaggcagagcttacagtgagccaagatcgcgccatgcactccagcctgggagacagagcgagactctgtctcaaaaaaaaagataatcaaatttggctaggtgcagtagctcatgcctgtaatccaagcactttgggaggctgagatgggtggatcacctgaggtcaggagttcgagaccagcctggccgacatggtaaaacccgtctctaataaaaatacaaaaattagccatacatggtggcacacacttgtaatcccagctactcaggaggaggaggcaggagaatcacttgaacttgggaggcagaggttgcagtgaacagagatcatgccactgcactccagcctgggcgacagagtgatactcatctcacaaaaaaaaaaaaaaaaaaaaaaaaagaaagaaagaaaagaaaaaaagatactcaaatttattatctcccagtttctgtaggtcagaaatctggtatgggtctaactgggcttaggtcaaggtatcagccagagctgtagttctcacctggggctcactgttggttgaattcatttcttctcacattttccacggcccccatctttgagccaccaatgctgtgtcatgcttagaaatctctctgacttcctcttctgccctcagtcaggaggaaactctgcttttaagggtttgtgtgattattctgggcccacccagatagtccaggatgacctttctattttaaggtgaactgattagtaatcttaagtatatctgcaaagtcccttttgtcatgtaatgtaatattcagacgcatgacagcagggggcaaaggtcctaagggtcaaaattctatctgccacaagcagtagaataatattccatgaacgaacaatatgccatgaccaaaccagttactataggaacaaaagactggcttactaatattaacataatttataataccaatgtgtcaaaaaggaaaaacaattttaaaggatgctgaaaagctcttgataaacattaactagagattttaaatcacggagctatacttctttttttttttttgagacggagtctcactctgtcgctcaggctggagcgcagtggcgtgatctcagctcactgcaaactccgcctcctgggttcacaccattctcctgcctcagactcccaagtagctgggactacaggcggccgccaccacgtccagctaattttttgtattttttagtagagacgggtttcaccatgttagccaggatggtctcgatctcctgacctcatgatccacccacctcggcctcccaaagtgctgggattacaggcgtgagccactgtgcccggccaacttctttaacttcatacaaattgtatgcacttcaaaccaaaagccagtagcaccttaatgtcagcagtaccaggacagcccttatggtcaggaaaaaccaccgtgtcgatcatgacaccctgttctgaaagtaccgcccaacaagagtaaaatgaaaagtataaatattgaaaaggaagaggcaaaaggatgagtatttgtagatgacatggtcatctacctgtaaaacccaagagaatcaactgaaaaactatccaaaacagtaagagggtttgagaaggtggctggggtataaaataagtaagccaaaatcaatgtcttttgtatactcttgaaaaacccccttagaaaatatggaatgaaaatatcttattataatatcagtaagaagaacaagagataatatacctagaaataaaataaaaaatgcgagacccaaggaagtgttgatattttcactagaagcaaagacagaatatatccatgtcaaactgtaacggattgtattagtccgtttcacactgctataaacaactacttgagactgggtaatttataaaggaaagaggtttaattgattcacagttccacatggctggggaggcctcaggaaacttacagtcatggcaaaaggtaaaggggaagcaaggcacatcttacatggcagcaggagagagacagagagagagcaaagggggaggtgccacactttaaaaccatcagatctcgtgagaactcattcactatcatgagaacagcatggaggaaaccgcccccatgatccgatcacctctcaccaggtccctccctaacatgtggggattatagttcaagatgagatttgggtgggaacacagagccaaaccatatcacagatcaatttgaaaatctaaggcaattccagctaaaatttcaatggcagtttctttttgtacatgataaaatcattatagtgctcgtttggaataataaatatataaaatagacaataaagaagatcaatgagagggccttgtcctgcattgactattgaaatacagatatgacaaaagtaaagtagttaaacagagaggtactactgcagaaatagacactcagaaaagagaaagttcagaaacaggcccagtatattgagagactaaacacacagtttgatgatggtcagaccatatataaaaagagaactggaacccacaacctgcagcaacctgcccggggtgtcagaccacaatctctgcagcaatcagccccaaaggaccaggacttgatcaggaattgacagcttccctcatttttgccaccatttgcaaggtatgaccaaccagagaaagccaaatatgttcccttaaccagtcacacaggaggccccgcctctagttaacccacccagcttccccaagccaacagcctccaactggggcatggtagaaccgaagcctttcccaccttccactagaatgctgtcacctccgctgcctgcctgtgagcctctgccaaaacgccaagcaatggtggctgaccccttgctattgcaagctcagactaaatagcctttgcttgctttcactttggtgggcttcactgctctccacaatatatacaattgtgatgagctctcaagttcaaactagtagagggaagacagaacatccagtgatattcaacactctgaacaaatggttaaccatttggggaaaaaataaaagggggactcatactgcctactcacatccaaataaatatcagctgcaccaaagatttaaatataaaaatgaaactgtaaaaatagtagaagaaaacatccattgatttgtataacaattccccaaggaaggcaagactggtatttattactgttttacagatgagggtccatcaaggagggtgaaagccaggatttgaacccaagcctgactcctagtccaccgggcagatgggatgggtgggaatggggatgaccaggagacattccacttcaggaacacgtgaaggcttgtgtaacctggaccccttcagctgagccctggagagggggtgcccaggggcttggccagggctgctggcttggctggggcagctcacctgttgggattgtagcccaggcggttcagcaggtgtgcctggtcgaggtcccgcgggacgccgtgtagcacccagcctttctggatgcagtcctgctggtccaggcgctggctcagcaccttcatgaggaggctgtcaggaactgcagagaaggggggcaagtgagtaccctgctggccggcagcccatgggtcctgggcttcctaactttacttggccatagattgagctgctgaagaagtgggtctaggtggagccacttggaaccacttggacaaggttgtcagtgcctatttcccaggtccctcctcggtcccagcaacggggctgcgtgagatgggaaatgcactggctgaccttgacctcggtctttccctttcctggacacgacaccatccccacctgcaacccagtgagatgtgagcagattgtccccctgtcttagtccatttgggctgctatagcaaaatcccgtaaactgggtgtctggggagtctaagatcaagtcagattcagtgcctggaaagggcctattttctggttcacagatggtgccttcttgcttcatcctcacctggtggaaggggtgagaagtctctctggggtctcccttatacgggcactaatcccatccacaagggcccctgccttgtgacctcatcacctcccaaaggtcccatctaacaccattgtcttggggattagattttaacatatgaattttgggatgacacattcagaccatagcaaccactatgggcccagtttttgcagcaaacacttttcctggaagcgcaccagctccagctgcagtttcagttttcctcaagtgggactgtgccagcgcccccaaagctctctgccagtctgtgatgcgctagcaacgcccactcccctttcccaaaattctccaattctcccatccttgatgcttagaacgaagtctctcccaagaatcacagaactagttataaccaaagactgaaataaagtcctaaggagaatgagatattgagaagcctcttgtttacattgcggcaattgacattttcctgaaattcatacgtctcttcccagactcattaaatgtcctatgttgctaatgtactgcgttctagcaatttgcactgtgtttcctgcactttgcactcatttttccagaaatacttggtaaatattaccattgtttgctatgactgtggccccattggaactggttcctaggggtgtggtggcagtgagtttggcagtttctctggaagctgcctggttaccctcctaccgactgcccgggggtctggcaagcgggcctgaagcacacatttgaaaccttccacagggccccccaggctgacagccaggtgaacgtggaagcaagagatgcagaaaaatcactgccagccgttttccctgtggccgtgacttgctgggttgctgcccttgtcaccaaaaaaccataaccctaattctaagcagtctgcatttccctgaatgtgttctctctcatgcccttcagcctttcttccccagtccctaggaaagagcagaaaagggtttttgctttaacgagaacatctggctatctagcatgaatgagaagtcacttcagcgaatcccatcccttcccctgcttcaaacctgcaggggctccccagtgctccgaggataaagagcagtctcctttccaaggcaaggtctgtgccctgccttcctcccaggtgaatcttgccagcttgcacctcccttcgaacgtgccacctcctccatccggaacacccttctcccacatcttgcctgggccagccttcaaactcagcctcagggccacggtgtgatgttccctccccagggaagtctctgaggacagcccccagcctgcacttctcatcctccctcacttgccacccttgttatcacaaagatacttctctctgggtgattctttctttaatgtctgcgtctctttcatggatgggtcccataataacaaagaaccatgtctctcccatttttccctgcctagaaagatgtctggcacatagtaggtgttgaataaatagaaggcttctctttttcaaatatttcaaaagtaatcaactctgttaaaatcaacttgaccagactttggggaagccaggttgtagacagaacatgggcttggggcattcacaaatccaggtctcatctcagctcctccctttcttgctgcctcatctccaggcagtctctcactctctgagcgtcagcttcctatctgctgaaaggataagaggacctgttgtgaccggctcacaccgcatttacgattctggcacacagccgacactcaaaggtggtggctattacttttcaattcaggagatgtgtgtggggaagtgatgcttcacgaatattttcacggttgcctgtggtcagggcgtgccagcaaagactgttggcacctgggataaaggatgacagattaagaacagccttggaagttaaagacagagacctccagagagacttagggacctctgcctcgagacatttgtttacattcaaagggctgtaaacctagtgacctcctcctcctctccccagaaggagtcggagtcagagtcggttccttccagagtaaagctcgggagggagctggcatgttgtcttgcataagctccaagagtcacagtgttggggctcccctcctgctatagaccccctgtacactcggggtgcacttggctctttccacattgcctgtgaggaactggggcgtggggagccagctctgagattactgtgtgaaagaatttggtctgtcctctgatccagagaccttgtgttttcttgccaggatgaataaataccgatttaaaacaatgtagggtaagaatctgccatagagccttccagtccaggtctacccttaatatttacagatattttcacggaaagaagaaaccaatacagaaataatcctatccccacgattcacccagtgggtagttgctgaccatctaggctgtgccaggcactgtgctggacatgggatacggtctacgcagcaagcctgactgccaaggcccccgggctcctgaagttcacgctgtctcggggagacaaacattacccaggtaacaaataaccatttctaagagtcatgggtactgtgaagaaaatcaaccaaatgatgggaggctgatggtttgaccgggcctaggacggctactaaggaggccgcatttggctgagatcagaatggtggatcccgctaataatccaggcccactaaggcctccattgtttagcggtgagaattatttggaccaaatattttctgagtgtcatctctaataatcaagtatggcttggaaacccagctgcactgtaggtggtctgacctttggagccacagctttctgagggcctggaaggtcatcccattgacctcttgtttcaaagttaggaaactgaagcccaaagaggttgtggtttaagtgacccgcccaaggtcatctagccagctggtgatcaggctgggataggaccctgatccccggcccataacacccccaactgttctgctgcctcattacccaatggcctggagcccctgagtccctcacattggccacttacgaaccaatacaaagtttctcaactgaggagaaatctgactcgagggaaaaatggaaggccagatagaaatacaatgaggtttttgtttttgttttttctgttagttgacaaagatttctagagagaatttcccaacttgcatcaaaatttaaaatgtacatgtcttttgacccagcaatcctatttctaagaacttgaacctaagaggggaaaaagatgtgtatacaaagatgtccatttcagtgttgtttacaatagtgacaactggaaatgatctagaatgtccatcaatagaggacagattaaatcaaagaaggtacatctctgcaatagaatattagacaaccttttaaaaacaatctctatattaacttgcaaagttaatatagacaggtcgaggcagaagtctatgacagaatgagaaaaaagcaggtaaataaacggcttgtatacatggtctaatttaaacatatattcatatgtgactatattaatatatacacatacatacatgctacacacacacacacacacacacacacacacacacacacacacacacagagggagggggaagggtggccgccacttcacgctccatgaatcggactcaagcccttgctcatggagcccagggtggtggaggtgagagggcacccggatgtaatgcaacacaaacctggcaggaaagcagaggtcacagaagtaggaagtgctggggatgtcggaggcagggagggccaaatttccaaaagattgaggaagaaagggaatgctcacgctggttcccactttgagccaaaacccaaacaaacccctctctgcaggaatcaggaaacacaggctctgcagccagcacttcctggaagggctcatcacaagcgcacatcagtaacaactgatgtagtatccacttaatacctgcattcccaccccaatgcccaccccatgaaagcagggatccccccagtagggtcaggctcattgctataccccagcacctggcacagtactgggcccacggaaagcatctaataaacacgaaggaaggaaggaagggagggagggaaggaaaaaagggaaccatttccaaaacccaggaagttctttagttcctcaagcgttcatgggccagagaacttaaggacttttctcaccaagcactgaatcaggtcctgcggcaacagaaaataaccaagggagacgcttcctctcagtcgttccattcatctctacgtgatcacccactcgtgaattaaatatgcagccaaaagaatgagcactagcacctggggtttgttgggaggggtctctggggtaggggagggtggttctagatgcaacaagggtggccacaagcacgtgaggttcattatactagcgatggctcccacaggttcattattctattctctctgctttttagatgtgtttaacgttttccactaaaaatgtgatttttttttaaaggaaaccatttaatgcttaaaacagattgaaatggcccctgtgagagaccgttcctaaagtgacaaaggacacaatctcccccgaaggccatgggcggctctcccttttgggggacctgcagtttgggtggcctccagccgtcctgtaactccaccagttccggaagctctgcccagaagcctggcatcacgggcacttgcccacatctgcctgtgttagcagtcctgcgaaagctcctcgttcgagtcctttaaccttttataaggaacagcaacacattttggctcacagttcctcactggggctgcgtggctaaggaactgcactggtcctctcccagcgcacagggatcctggatcctggtagggctctcccatctgggtcaagacaagcaacagaccccactgggtgctgctctgaggctaccgacctttcccagtcagcatctctcctcagtggcagcacgcagggttgaggagtgaggggtgaaccctgaagaccctgcctttagtgtaaattccccaaacccacccatgtctcctgtcccagcctctctgaggctcggtgtctgttttgctgtggcttgtttggattttcctgccagctatggactcacgtttccagccccacatggtctgactggccagctcagcacaaagctgagaacaagctgctccttggttcactgtgctctgccagaagtttcgagtcctcttgataatgctgtccatttaccctttctcctcctctcagacagagatttttcagtgcggtctaaagtctttcaccattaagtcagatgcctcaggcttgatttctgggcttgacagttaacatctcacccttcatacaaagctaccgccaagggttacctctctggagtgttctgtcagccctaaatttagccaactgcaagatatgagtatctcattatttcataaggccacaccacatggtttcgtttgtttttttttttttttttctcaagatcttccataaaagatggcagtcctcaagttgacctccaggttattaaaatctcaatccatttattccccgcggggctgggtgtgcttggcccttggcatgggggtagatggggatccatggtggcaagtgggatgctcccaggcctccactccccaccgcgggcccgtgtcccaccctcctgtctcgaaggggaaggagtcctgtctaaaggcccaggatcccattgggctccctcccgcacagcagttccacggctccggacaggagtcccgacacccatgagatgcaactgggcagcactgactcctcccgggctgcaggtctggcttcagtcaccctcggtcacatccagctccagagctgatgggtgtgagtagggaagggctcggagagagcacccaggccagcttgcggttttccagcaggcaccagaggcccctcctgctgcgccacgccgccgcctgctgtccgcaccgcagagccagccctgcagggaccttggctttctgcccatcagttattgttgagggagaagatatgagggacactaaggtttctggggctggcatataaagataggacaaaaagtggagagaaggaaatagctccttcagccagtggcttaaagataaaaaacatgctaaggttgattgctagactcacgacaagccatgtgagcctccttggcaccctagggcaaacaggaaagagctgagtgcctccccacacacccttgcacatgccctgcacacgtcacccctccatgcacactcataaacgcccccacacactacatacatgtctacacacacgacacctgacacactacaacacacacaggcacgcacacacacagacatgtgctcatgcactcagctacaaacacacacacacacacaccacacacccccacacccctacaccccaccacgtgcacaacacatactgtatacccacctatccacacatagtacacgaagcacacaccctcattacacaaacacatctagcaaacacacctacatacctacaccgcacccacactgcctctcctcatccctcacattcgcttcaaactgcccggtgtaacttctttccttcttcaagccctccttgaaattgatgtcaagatgagcatcagtgttcatgggggaggctggcatttgcttctctttctcctgtggtccctgggtccctgggtcccgcccctcctgaaggatcccaataggacccaggaggtccagggaatcttacaaaaggaacaggactgtggaggaggaaaaggggttgcttttggttttgttttttaatttccatttcacacaacctggtgcctgaaagaagcggggctcgcatcccgccaggggctctactctaggctgctgggaggtttgcccaggccctgacttaattcaaggaaagccgaacgcctcccatctctggaggccatcactctcgggatggcactgattcccggcagctgggcctgcaagcccgtctcgctgccgtcaccagaaatcctgcgtgccctgaaggccctgcagcgccccagtgccaggacctggcgccaggtgtttctgttggtgatgccgtttgtttgttatttactaccacctgctggtgaaacatgggttctgcatcccccaagtgaacgccgccagcaacgcacagaacatttccaaaccctggagaagagaatgaggagaaactgggattgttccatcggccgcaccctgcaattcctaagggagggtaaggccactggatctagcttgctctttggtaaactcaagtcaattgccccagacaaacccccatctggccgggccttggttccccaagtaggagatgaaacagatgccttccatggttttcttagacgccaacctttctactctaatatctctactgcttaacaacgtttaaaattgcctggcagacaatggcgccaggaaataacaatgtgttaatactggattttctttcaagaccagagaagtcagtacatcagccctgggtgccctgcagactaggaggccatgttgtgcccctcctcccttggagagggccacccactttctgtcactctcttctttaccatgtctactcaggcaaaaggcaaagacaagactgaggtgcccacacggcattgacacagctacctgaggggcagagatgcccaacagtgaatatttcagtttgtccttttttttttttttttttttgagacggagtagtctcgctctgtcgcccaggctggagtgcagtggcgcgatttcggatcactacaacctctacctcctgagttcaagagattctcctgcctcagcctcgtgagtgactgggattacagaagtgcgccaccaggcccggctaattttttttgtatttttagtagaaatggggtttcaccatgttggctacgctggtcttgagttcctgacttcaggtgatctgcctgcctcggcctcccaaagtgctgggattataggcatgagccaccacgcctggccagtttgtccctttcaaatgaagttttaggtgacaaaagagaccattcaaaaatagacattcttctataaacaactggtacatcacttagcaaattagtaaaacttctctattggaaatgctcggctagccacactgtgcagaatgatttgacaatttttattttaaagtacatttttacatctttcaatggaatatgaaagtatctgggaaaatgagcagaggtcggccagtctgcatgtgaactggattattttaaagagtgatgtattcactaagtgtacactgcagatcaaagcatttaaggaacacgattttccttccattttaatgaattcagggcttagaaccagttttttctcccacatctcaagggcagcaaggatgccatagcccacgaaatctgggagaagaaagtcagcagcaaacagaaccatgagcccagttttctgggagggaaaagatatgatagtatattgactcaccaagcatgtatgctacagtgcatatgatgagcctggccctgttctaagcatgtctttgttctaatacaaatattaattcatgtagttttctccctatgaaagaagtagtcacagtatcccattttacagattagaaaactaaggcacaggaagaggaagtgacttgcccatggccatacagctcacaggtagtggagcttggatttgcatccagccaatccagctctggggctgcttgctgccacctgacttttaggaggacgagcactgtgacgatgaggactagaggcccaaactctgccctgcgctctgcattccacttgcagcctgcctttgggcgactcattttacctcctagccaaggcttcctcctcttcatggggacaaaattgggctccaaagccacggaggtattggtaggcccctgtgtggcacccgatgtcgcctggggatccagctcctgagggctgcttaggctgtggctgcctcccaggcacgtggtgcagcccatcctgaacaaaactaaaatgttcacatcaagccttccccggtgtggtgtgggagattaaagatggccacgccttctttgctactcctcccagggcagggggcgggaggggggcggtgtctcaatcccctccctggaacctgggctggccccagtgacaagctctgtgaacagattcagacagaagtgtatcctggggtgtctgtggtgaagtcatgggatgcctggccgctggccccaccttccaccccaaccactgccgcccttgaactctctggagtgcttgtgccaggagcagccagacaccaagtaagaaggcaggtgaagccagccccacggagaggctgtgaggagggaagatgcctggccagccccagccattccaagcgtgccctcccaggcaccgggcatggcgatgaagaatccgtcttggacacactatccctgcagatgcaacgtggagaaaaaccaaggaatcaagctgacgccagaactgagatccagatgtaaatccccgggtgagccagcccagctctcttaggcagttcaaggcatcccacctaagcccaagtcagcacagagcagagtcgagacctccttgccatgtcctgccccaaaccctgacccactaaatcaggagcataataaactcagcgtcattttatgccattaaattggggggtagcttgttaggctacaagagatacttgggggacatacccaagactgggtaatttataaaggaaagaggtttaatggactcacagttctgcaaggctggggaggccttgggaaacttacaatcatggcagaaggggaagcaaacacgtccttcttcacatagcggcagccaggagaggtgcagagcgaaggggcagagcgggggaaagccctttataaaaccatcagatcttgtgagaactcactatcacgagaacagcatggaggtaaccacccccaagattcaattacctcccaccgggtccctcccatgacacgtgaggattatgggaactacagttcaagatgagatttgggtggggacacagccaaaccatatcacggagcatcagagtaatgcaaactggagctttgtcagttcccagttaccgcagggactaggtccccaaagctggtagcagtcatgggaaataaataaatataaaaaatcccccatatataaaatatattcacacccgacaggacttgctgtgagtaccattactaccactaagatgatgacgatggcaactccattcttgataataatcatggtgagtaatcagtgattacaaccagtgaccatagtaagtaattagtgaattacagacacaattccctttatatagagcaagccaacaaatgggatcctaggaaagctcgccttacagatgggaaaactgaagggagctctgagggggcgcatggcttgcccaggagcacagctgggaggaagcagagtctgaatgggaaccaagtctgtgtgattctgagccacggcccctcccatctgggagtgacagtcacttgcctcccttctagaaatccttcaggctgcatgctgccccctgtgacctgtctcctctttgttccttcaagactaattctctgggccgggcatggtggttcacgcctgtaatcccagcactttgggaggccgaggctggcggatcacgaggtcaagagatggagacctggccaatatggtgaaaccccatctctactaaaaatacaaaaattagccgggcgtggtggtgggcgcctgtagtcccagttactcaggaggttgaggcaggagaatcgcttgaacccaggaggcgaaagttgtagtgagccgagatcgcgccactgcgatccagcctggggacagagtgagactccatctcaaaaaaaaaaaaaaaaaaaaaaagactaattctctgaagccactggggctgcccatggagagggacctcacccgaatagaaatgcaggcagcagagggcagcatctgggccctgggattgtccacaccacagggacccaggtcaactgccacaggcttgctcttccactaaactagctgagctcctaccatgagccctgcgggagctgactcctcagcccttgaagcagccggccgagcagacagcgtgagcagaaacagggggatcctggggtagggaggtcccagatgaggccatctcatctcccagtaaaaaccaaccaaaggctggggggaggtcagagtcctgcaatcaagatcgtggatggggtaaatcagaggtctgcagtgaggggtgaggagaaggagttccccttcccctgcctcccgcatcccctggcttccacaggctcttcccagggaggggggtgggagcaggtacatccctctgtatgtcaggaagtctcttccctcgcctctccccctcccgtgtccctctgctcccatcttgcttcttctgtcgggtgtgcccttgtcacccagagcagcagcgacaggtgtgaagctgcagggcgtggtccccgcttccctccctctatgtccgatgaggctgtgccaagttcccttgcacaggaaacctcagagccagcttctggttgacaaaccccagcaagtcccacctccctgatcataagtgtagaggctgcagagggtcactggggccacctcttcctcacccctcatgtcctgcccctgcctctgcaggccccgctcacagcccaatgagaaagaacccgtgtcagctcccgtcaggcgaggatgttcccagagggaaagaggcttcaagctgcacctgccgttggggggtctgtgaggggcaggagcacagctctagccatgccaagggctgcccagacagctacactgagagacctcccgactggagaagaaggcccggggcctccagggtcaggcctgtcagagacaatttcacagctgagcgcactggcggtttgctcttctctgaagccgctggggctgcccacggagagggaaacgcttctagaagctctggtcagagcaaggatgactctgtgcactccggctctccttggacttcccagaaatgtcagggttgggttgggtttcttttttaatctggatgcctgatacacagcaacacttgacattcagcccaacaggaaaatctggctgtgcccctatggtggctccagccagtgacaaggaacagcgctaagcaggccagacctacccccctccggcagcgcccattcttcttggggagacaatgttgtcgaatggatgcatgaatgaatctggcatcacttactgcctcagtttccccactggactagccattgagcaaaggctttttgatcttttggtgacggggctgcctcctggcaaagcatcattttcataccggagaaagacaaggcacactttcaaaatcaaagtctagtgtaaaaaaaatcaaagagaaggaccctcgggggcacaaacctgttgataagcaaaggtgctcacccgcttcctctaactgtgctcattcctaggccctccagcccccacaatgcaaacaacgcttttaccctgccactctgcttggctatcttggccacagctttctctctggctgaaaaagactcctacctagtttccatgaggaaatctttgtagcagtcccagcggaaaagtcaaaagtttgacttgaaaaaaggagctacttcaaaagcattgtcagaccgaggtgagggttcctttaaaatgcataaattacagggggcatccattaataaacctctaggccaccctacagcgggggctctgggttgggggtaccaaagggacagaggccaacacacctgggggaggcaacgcgaaggaaatccacatagaataagagtaaattaatgtgtttattacttactgcttggcgtgtgtgtgtgtgtgtgtgtgtgtgtagaaaaatgaaagaaaaatgtagagttttttcaataataaaaagggagttgcactgcggggcccctaaagcttgtgaaaaattaaactcgacggattcaaactgtcctatttccacttcaaaagagaagaggcactgagctcttcccaacttatcttcaaacgcccagcaccctagaaagtttctttaaaaaaataaaggctcctgttcccccaagcactgtaccggttactgtacccactgtctctccctcttctaattatacccctgtgagtctattaatcaacttgtaaattatttagagagtcatgcgctgtcttcagcgagtacaaacacaccgcatgcaaaggcttgctggaaacgggcagagggtccctcagggtctcccctccacgggaagacagcttgcagctggccgaggctgctctgctaaaaacaagaaatagcattccgcttacctcctcagatggggagatttactttgtctttcaactcagcaactctttgcaagtttttaacaaaagagaaaaactggtctatggtcgatctttagtgtgcatttagtgatgagaatattaattcccccttaaaaatgcagcactttggctgagctctgatccacacctcctgggatctggactcacggaaggctcttgaaaacacatcatcatcccaattgggggctggtttggcttgtttgtattacgatggctgcatttgctagggtgaggtctcattaccagaaagggtgcaaattagcttcttgaaactctctcaaatctcccgccttttctcgggttctattaggccatgagggacctttcccagacagaaatgtttaggaaatgtagggatgtgtgggaggggcacaggtaacaactcgataatgatctgtcttccacatcaccttttctacataccaggactttcgcttttaggggaaagtcattaccaattaaatagctgtcttccctcctgacaataagaaaggaatatgtctggtatgtgccaaggaatgtgggccttcctacaactgaactgctttagctgttgggagatgctggggggggcggggccacaggggcagctgccagttaggagctcaccgtaactgggccgacgagccagttgggcaggtgttgcagagtgtatgcagagacaggagatgtgaaaagctacagtctagctcagaagccccactgctggggacatggcatggctggcgggctcctgaccatgcagttccagcatgttccgagtgcgctgtggacaggctgagatgagcatctcatgcacttggagcaaagacataaaccagcaaggacaagatctgcctttggctgtttttcatctcctccctggataaccaccctccagaggaagtccaagcaactcatgagaacgagaacagttccttgggccagggcagaagccaagccttctggctgaagagccggcgttgtaccattcactgggcccggcaacctggaagtaggttatatccaccatcaacagtccctggaccctaatttatggctaaaattctcatgagaaaggctaaaaataaagcagtgcagacttcagacttctttatgttgggtgagtttgaacaacagagtgaggcccatgagcagggctcattttatattaagtgaaaatcgggaagcgacattccaagaggcaaagacagaattatggccaatttccttaggaagctctgggcctccagaattcagaaatttcaaacacacttcggtaggaatggagctatggggaaggagctgaggacatcatttggcagtggtggccactgtgagccaccgctgatttaagcaaagaactgagatctagtagcgcctttgcttgagttcagagaggaaagaggacatctgtacacatgctgtagaacacggtggcaatggagtccatcagcagcaaccatctcattttaaatgatacagaaacagctgagaacttatttttccaaaagcccagaatcgtttttacttgttttgtactagtgtaaaagtgacaggagctccctggcaactaaggctgcatgatttaagctcgaccctgtttatcgtatgcagagcaaactcctggtgactttaatggaggttgcctgcataaagaactccacgtgcggagccctggggaataaatttgttctgttcactgcagctcaagtcagaacgagtttagggggtcagacctatatatttcaaagtccaggcacagaataagcatctccccagtcctctgtccacagtgccatcaccaagagcctgggatcaagggactgaagatgcgctaagatggggccctggggtcctttgcccagtaaatgtggaaagatgggaaaacagtacagttattaattttgctgctgattcgaaagaaggaggtgttggcagcacctgtgaggacaaaaaaagaacataactaagtctgcagaggtcacggctgggacataacatcatgaggcctggagtggggataagagcaagaggctgcacggggaaaagatgacatctggctctatttggctgagccagtgatggtggtgatggtgactgtgagggtggcagggatgcacaataacaaaagcgcacatctctggggcacgcagctccaaggtgagtggagagaaagcacaagtctgcaatggcaggggtcccagtgaaagaccagcagaaggccagcagccgggagcacaggcagggcggagtccccagggaaggaggtccagtacccaccagggcaatgagggggtacccaggaagactctatagtgcctggcttggggagtggtggggatgggctttctgcactgggtggctagatggtagggtgttctggcagtgacacctgcaagctcagagatgctaggggcctctgccccatggcgatgaggtctccatgtctttacaataatctcacttgctgagctcctgaaccttacagatgaaaactcctaacaggcaggggagtgactgggtgctttcctatgttcccaggaatgccgctggcacccaggacagagatatctgaaacagacctaggattgaaaaggggaatctgggatgtctccaatgactccccaaaggtatatgggagagcaccaaccagcagctcctcttctggaagttctgaaagcctcaggggatacagcagcatgtcctccagtttcaggaggcagggcaggtccttctggttgcagggcagtgttcggaagctgaattccactgttcccttcaccctgtggcctccctcttccccagagcagggagtcactccacgacaggccaagtccctccggctctcccatcctcccgctggcaggcactggcccacagtgcagaggaatttccttccacatctgcctccactcagtcagggctcttcctggggcaagcgtgggggcccatctccctgtccccaccactggagtatggccatacaatgggtggtttgtctccaggcctggcctccaaagggcacgttaagcccaaatgtgacctgggttctcagccacattatccattctatgctctcagcaaactctgaggtctgtctcctatcgggttcagaactcaggatgaggggaagggatgtggttaatcaccacccctcaagcccaaacagtggggtacacctgcaggctaggggacccctaagtcacagatgtcaccaatgctcaattcgggaaggagggggcctcagccagctgggcttattcataaataagcaggctgtggtcggctaggcagagtttccctgttcagcctgaccttcccttcaaaaccaaattctgtcaagaatcatttaaattttcttcctgtttcagctggcggtgaagtgggtccctgccagacctgggtggttccagcgctcctgctctgcgagctgagcgctttggttttctcggcagcttctccacagcccactaatgagaccctgttagtggttatgaatgtaaatgcattctttgttatccctgcgagatcaggattagtgaaatgacagaatttattgcttccgttagggagatatgatattggttgttgttgtgtctttaattttgtaggaagagcgaaagtatagaggtacatagtctaaataaacaaaaagctgtggaagaaaaaatttagcatgaaacattgaagatcgaagtgatccgggtctcgctaactttatagaaaattgggaattgtgccgtcagcctcctttgcatcccccaaataacaaaaaacaaacacaaaaacgactctgcgcctggaccacctttgaaaggactcttgggtttgcttttagtggtggatgaattaagccggctctgtacaaagttgacgtgctttgattcaagcaaattcatttctgtctctcgaagaggaagtaacaataggtcccatttactcaaaagatacagtttgaataagtcagcaaaatggtgcccatatctgatgattaattaaggatctgtaaacgcccaactccctataagacgaggaagataagactgtgctgtcagatggtgaggagagaggagatgaggaaaccaggaggccgagtgctccgtgacctcataaaaaaccaacatcctcatatgaccttcttggcgaccgtgacatcccacgatgcctgagaactaaagggccgcgatgagccactgttctctttccaagcaattgctaaaactacaaaattataacgtgacttgaaacagagataaaatatagaatgtaagtataaagaaaaattaatggaaaaacgtaaacaaccctaatatgcaaagagcactgacaaaccaattaggacaaaaaattgcttaactggaaaatgggcaaagggaaaaacagttaataggccagggctatagagaggtggttcacaaagataaaacacacgtgaccaattatcttatgaaaatacgttcaactttaccaacctcaccgacaatcataagaccacaattaaaaataaatacatcttttgtcacataacaaagtggcaaagattcaaatggctggccatggcaggcagaataatacctcccaaaaagatgtccacatcctaatcgctggcacctgtgaatatgttccctgatatggcaaaaagggctctgcaaaggggactaaattaaggatctggagatgaagagatgatcctggatcgttctgggtcatcccaagggtccttataagaaggaggtaagagggtcagagtcagagagggaggtgtgatagcagaagcagaagtcagagagagagagattggaaaatgctactctactggctttgaagacagaggaaggggccacgagccaaagcatggggatggcccccagaagctggaaaaggcaaggaagtaaatcctctcaagtgccccaggaaggagcacagccctactaatacctggatttcaggacttctgacctacagaactgcaagataaatctgtgttgttctaaaccatgacatttgttatgaagtaacagaagacaaatacactggcagtacccagagatggcaaagacaggcagggaatgagcattcgcacactgatggtgggagcgtatggcagtacagcatcaccactgccactgttcatgggcatcactgctgactcaggcctcagggtatcctaataagatcaccagggatgtttctccatacaagagtgtgcattttagtattattgaaggactgcaaatctggaaaccaccaaaatatttatttttgtaattttatattttgaaaaaaattcaaatggacaaggaagctgcaagaagagtcaaagaattcctgcagacccttccctggtgttggccgattggcactacctcagctgcttggccattgtctctgtttctgaaccactatctggttagtggggaattaaattatcttccaggcatactatggaatactactagcaacccttgaaactatatacattaggttaatttggtatcacattcactcatttttagggtgctaatccccatcccagtaaatgggaatttggagagaaatggagagaaattatgcttgaggatgcaacaggtactccgccattgctgctgcttgctactgtggctttttttttttttttttttttttgagactgagtctcactctgtcacccaggcaagagtgtggtgcaatcttggctcacggcaacctctgcctccccggttcaagcgattctcctgcttcaacctcccgagtagctgggactacaggcgcccaccaccacacgtggctaatttttttttttttgtatttttagtagagatggggttttgccatgttggccaggctggtctcgaattcttgagctgaaaacatccacccgcctcggccttccaaagtgctgggatgacaggggtgagctaccgtgcccactgggatgacgggtgagccgccgcgcccggccgctaggtggatttgaagagcagcagctgcctgtggcctcccagaccctgtgcatgtgcatgagggctgctcctcaggacgaccttgcaggaagggacctctacctccatcctgccacccggaagcctggggcttcgagaagggcagggtggtttattggtgccacatggctggtgggggcagcgctggaatctgaaccagactgggaagcataagagctcgtgctggttttcaccctccctggtgcctcctacatccacctcattctgtggccaccgcagacacccaggaccagacccactcactgccctgagcctacacagatcacctcattctgtggccaccgcagacacccaggaccagacctgctcactgccctgagcctacacagatcacctcattctgtggccaccgcagacacccaggaccagacccgctcactgccctgcacctacagagatcacctcattctgtggccaccgcagacacccaggaccagacccgctcactgccctgagcctacacagatcacctcattctgtggccaccgcagacacccaggaccagacctgctcactgccctgagcctacacagatcacctcattctgtggccaccgcagacacccaggaccagacccgctcactgccctgcacctacacagatcattgcgtctgacggctcctactccacacacttgaactccaccccgcggactaggacatcttaaggagggacttgggagggctggccaggacatctcccggggaggcccaagcagaggatggctgggaggacagagcctgttttcatgtgcttcctcctcatcaacctgctccatctagaaagtggtaggagaaggccacaagcttccaccaggaggattcctagccaatgcccgcactgctcactataatggcagctgcttctggaattcattttcttcacaataagcacgtgttcacaacagacttgataagtgggtgtgcactgactgcagggaggagctgcagcatgtgcaggggaggaaggtgtgggtgcgtgagtgggaaattcactgccccagggaagagacagatgcaggatccccagaagcccagccgccaactggctgtgtggcctcagcagctcagtcccttctctgaggctccttcgtggactcaggaagcctgactagaatgctcccaaaggtgcccttactgtgggtcagatcctaggaaagctttcagactgtggatcacagagggcacctgggaagaggatctggtcctgcttcgcctgtcaaacaggcgagcatctaactgctgaggaccaatgccggtcaacactcacatctgcaaagctgtctgaaacttctggcttctaagtgctgattaaattggaatatttgcccacagtatttttatataccaaataataaaggatgtgggggcaggaagtggtggcttacacctgtaatcccagcgttttgggaggctgaaacaggaggatcacttgagcccaggagttcaagatcagcctgggcaacatggagaaatcccatctctacaaagaatacaaaaaattagccaggcatggtggcatgcacctgtagtcccagctacttgggaggctgaggtgggaggataacctgagcccaggaggttgaggctgtagtgagctgagactgcaccactgcactccagtctgagtgacagattgataccctgtctcaaaaaaaaaaaaaaaaaaaaaaaaaaaaaaggatgtggggaggtctgtggcctctcctggctctcaattttaaatggtaccagttatgaaaagccaaccgtcttgagaaataggaacatcctaaaccatcagggataacccccccacatccacaaactcacctcactggggatcgggctcagacaccaagaggccttaccggaagcaagcagcagagcctttgcttacaagaaaacccaatttccatttcccggctgttctccccaattttgagcccctgaatgttcagagagccgcacaaaaagaaagttctctctggagcctgtaaggtcatgacagttagtgggaacgtggcctacctgccatctccttttcaaagaagggctggatgagctcgccaaacgtggtcctatctgccacagcctctttcagcagttgcccacagcagactgaaggagaggggaacagaaagacacccattaaattttaaataggaggaaggatgagaaaaaaagaacccccagtgctgcctgctgagggaaaaaaaaaaggtcactgaaaaaagcataaaagggtttttctgtgtgtgggtatgtgtccaagtaaaagtaaatatcaaaaaggagccgggaaataaataaaagagagaggtggaatgaaaaggaatgcatttggcaaagaacacattaaaaatggacggcgtggggaagacactaacgaggatgttgcccacagaggagccctgcagggcctcgctgcacctggaattgctgcgcagaactcggcgccctccagggtgctgcggaggatcagcgttctggccgggggctgctcatctctgggcgatgtgcctcaagtgcgtccacatttgcacccttgttacacagcagagggggtgcagtgtgttgcttccacagcccttccagctggcagggcatctccatgggatggtggggccacacaatacgatagattcatattccaagtgggctgactcatcattaaagggcaccatgtggctgtaatcccagctttttggctgaggcgggcagatcacttaagatcaggagttcaagaccagcctggccaacatggtgaaaatccgtttctactaaaaatacaaaaattagccaggtgggtggcatatacctgtaatcccagctactggggaggctgaggcaggagaatcacttgaacctgggaggtggaggttgcagcgagccaagatcgcgtcactgcgctccagtctgggcaacagagcaagactccgtttcaaaaaaaaaaagaaaaagaaaaagaaaaaaaggtaccacgctgcagtcacctggccagtggcggctgccccgctctggacacctgctcgccctgggcaggaacctgcctctggccccactgtgtctcgagccctgagctagggccggcacaaaggaggtgctgggcaacaagcatgagtgaataaacacaggctacctcctccttggctgtgaaagtccttcctagccaaagccagaagatttaaactatattttcatgaattgttcactgcacgcttttggctttcttacctttagggctaagaagttttctgcctatactaaggagaccaaaaaacatcctaaagttaactggatagcatgaatgtttaacaaaattaccatcaccagggattcattcctcaataatgatatgcttaattcactatgtaaatgacagcagttgtcatttaatttaatccaatgtgcttggcagcctcaccagcaaaggacatataagtgagaataaaggctgctgggagctaggcgcagtggctcatgcctgtaatcccaggactttgggaggccaaggcgggaggatcatttgaggtcaggagcttgaaaccagcctggccaatatggtgaaactccgtctctactaaaaatacaaaaattagcccagtgtggtggtggaagcctgtaatcccagctacttgggaggctgaggcaggagaattgcttgagcccaggaggcggaggttgtagtgagcagagattggcaccactacactccagcctgggtgacagagggagactttgtctcaaaaaaaaaaaaagaaaaagaaagaaaagaaaaaaaaagctgctgagaactgagacaattctgtgtgccaagcactgtgctaagtgtgctttgttttatttggtcctcacaataacctgctgtttcttaggtaaagacactgaggctcaaagagatgaaataacctgctttaggtcacagagccattaaggggcagagctggggtccaaacccaggtctgcgtgacatcaaacccatgcttagcttccagttctggccatgaaggagtaacaggtatcatatttaacttctcttatagaaagctgtgaaactgaacaaaatctatgaagcaattctttagagtcattggacaacagagagacaggtctgtaatccttgagaggcaggaaacatacaaaacgagccccatagtcatcctggatttctacctatgggcacttctcaaatcatggcacaggagaagtggagcccaaacagatcagcagtctcactgggtggaagcaacaaagactggagctctgagacggccagaatttgtagaacagggtaagggagaggaggcagctgtgcacagaaggagttccagaaatctcataggggttcactgagcctttggccaatatgaagctgcacatgtgcagggtgagactccagaggcctggtagagaaaagctactgggaagctgtgaactgaatggaaattcacacagggctgggagatgctggcattctgacaaccaaagtgacagaccctgctgaacaccccggacattcagctgagattccagaaagggcagaccttagctgcagggatactctagccctagagtaagaacactctactcccacttaacaaagcctgaaaataagcttcagtaggatggagttaatcctccaaactcaatactcttaaagcagaatggtgacacaatccagaccttcaaaaatgtgagaaacacaatgtctagcatttaatcaaaagctccttgacatgcaaaaaagcaggaaaatgtgactcctatgaggagagaaaacaggccagagaatcagatcggggatgacacacatgtcagaatcagcacaccaggactttaaaacagctattatgagtacacttaaaaccttaaaggaaaagatagttaaaatgagtgaacagatggagaatctcagcagagaaaggaaaactgtgaaaaagaaccagatggaaattctggacctggaaaatacagtatcttaaatgaaacaaatcactaggtgtgctgcaatcagtgaatttaaagacaggataaaagaggcaataggaagtagccaaactgcagcaaagagggggatgggaaaggaccggaagaaaagaaccaaatctaagagacctagaggacaataccagacagtctaacatatgtggaactgtagttccagaaagaagagaggcaggcagaaaaaagatttcagaagataatgacaggagaacttcaaaatttgattaaaaatttcagcccacacacccaagaatctctgagatccaagcagaacaaacacaaagtaagtcacacttcgatacatcgtagtcaaattgctgaaagctaaagagaaaatattaacagcagctgagggcagggggagtgcttcacatgcagggcaacaatggtaaaaataacctctgagatttcatcagaagaagtgcaagccggaagacaatagaatgacatctttaaagtgttaagagaaagaaactgtcaacatagatttctatatgcagccaaaacatccttcaaaaatgaagatgaaatcatatcattttcaggctatgaaagctgagaaaatttgtcaccagcacactttcactacaagagctgttaaaggaagttcttcaggctgagaggaaatgataccagatggaaacctggatctaaaccaaggagtgaagagtactgataggtgggtacatataaaagtctctccccccttatatcttcacttctttaaaagatgaatgactatttaaaacaaaaataattacaatatattgtagggtttataacatacgcagaagtaaaatgtatgtcaactgtaaagaagtaaggtaaatggaaaaatctactgctgcgaggctctgatatcatacatggtgaggtgtaacattcactcaaaataggctgggacaagcaaaagatgcatatttaatccctagagcaaccactaacaaaataaagcaaagagatatggctaaaaaggaaatagaagaaagaaaatggattactaaaaaatacttggttaatccaaaaggtggcaggaaaggaggaacaaagaacagatgacacaagtagaaaacaaaacaaaacaaaaaaacaggccaggcttgagggctcatgcctgtaacttcagtgggaggccgaggcgggaggttcacttgagcccaggagtttgagggtgcaacgagctatgattgcaccactgtactccagccagggcaacagagcaagaccccgtctcttaaaaaaaaaaaagtgagacccaactatatgctgtttacaagacacatagttagactataagacacagatagtttaaaagaaaaagaatagaaggtatatcatacagacacaaatcataagaaagttagagaaacttcattaacatcagacaaagtggacttcaagaaaatgagtattgctagagaggaaaagcaacatttcctagcaataaaagggtcatttcaccaataacatataactatccttactgtatacagtcagccctccatatccatagtttctacactcatggattcaaccaaccacagattgaaaatatctggggtaaaaattacgtctgcactgaacatgtagtcttttttccttgtcagtattccctaaacaatacagtataacaactgttgcatagcatttacattatattaggtattataagtaatctagagatgatttaaagtgtataggagaatgtatgtaggttatatgcaaatactacgccattttgtatcagagactggaacatcctcggatttcagtatccaagggaggtcctagaaccaatcccccatggatactgaggtgtgacagtatgcacttaatgacaaattacatgaagcaaaaacttgcagagaatagacaaatccacaattcagagttgggagattttttaaatgttgggctggatgattgtaaaaaattaaaaataaaagagttgggagagtttaacacacctctctcaataactgacataataagtagagtgagaatcattaaggacatagacgaatttcaaaatttgattaaaaatttcaaacatcttatcctaatcgatattatagaacactataaccaacaatgcagaatacctatttttttaagtacacttggaattcaccagtatagaccatatatgcaaatttcaaaggatcaaaatcacatagggtatgttcttttaccacaatagaattaaattagaaatcaagactataaagcaatcaggaaaatccccaaatatgtgggaattaagcaaggtgtattctaaatagtacacaagtcaaaaaagaaaccagaggctgaggtgggaggattgcttcaggccaagaatttgagaccagactgggcaacatagagagattcccgtctttacaaaaaaaaattagctgagcatggtggcatacacctgtagtcccagctacttgggaggctgaggcgggaggatcacttgaggagttggaggctgcagtgagccatgactgcaccactgcattccagcctgggtgacagagtaagacccgaaaaaaaaaaaaaaaaaaagacaaagggaaggaaggaaggaaggaaggaaagaattcatgctcactgtaaaaaaaaaaaaaaatctgaattgtataatccacagctctgccgagataagcagtttggtgtatggatatttcttcatgctttttctgagcataaactaacatgcttttttgaacaaaaatgaggtcaccccctggatactgctgagcaaattgttttctgcccctcccttatttagccatgtatcactgacatcaaatcactttacaggtttatttttaacagctgcctcgcaatccattacatgggtttatcacaacttatttcacaaacctgcttattaacagagttagaggttgcctctgtttctcattatgcttctgccacatctctccttacatatctgagtgttggagcagaataaactcctaggagttaaatcccagggtcacagggtttgcgcagttagtgctttaaccaacagtggctttcgcctttcagaaagtcgtgtccgtatatactcccatcatcctaagtgaggtcttctgatgaactttgtgggagtgagtgtgggggctgtctgtttttttgttggtttggagatattttcctttggctgagagattcacagatgtgaagattagaaccaggcgagcggatggccgcagcggagcagacagcacctggagctctgggttcagacacgcatttgcagagagatctcaaggctacctgccttaggtctcttaaatgggtttacttaaatctcatgacatcttgtatttatcaagaacacctttgagaaatgtgaactttctgagatagtctccaaatgcttaattatctaaaagagccccatcatggctcttaggtaacaagcaaaaaccatgatgagcttttctattttcatttttggaaaaatctaggcaggtaatttcatctcttcatggctggtgtgctgaacgcaatttgaattaaaaaaaaaaaaccttttattgaatgagagtgtctgcatcataaaacagagcaccgagacaattatttccataaagccctgcactgcattaaagtattgctgccgtgttttcagactctccctccaccgcgagtgcccctccacgctcactctgtcccttcccgtaacgatgtgggcacatgcttacgtaagcaagtgatgccgccacaggtagactgctggtcatcggaacaaagaagccatccctaacactgctggaaatttcatcttataattctcttaagaggaacaatcaaaagaagaaggaattattgaaataatttatttttaaaaacggactcaggaacattttttattctaaatgtcctgattaattttccatagtaatcaaatttgcagagtaattgttcaggtctctatcttcattttaggtgtgtgacttttgtcatggattccttgctggtctcagtggctttagaattgtaagctggaggaggcctgagaagcatttttattcaaaacttgattcttctggggtggtatatacatatatttgtatgcatatacatatatatacacgtacatttgtatgtatatacatatatgtatatttgtatgtatatacaaatatatacatatatgtatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatacatacaaatgtacaaaaatgtacatatatttgtaggtatatttgtgtgtgtccatatatttgtttgtattccctctctatattcatatggtatgcctgtataatttgggggggttgtatgcatatgcatatatttgggggtgcaggtctcgtttccttagtaaatacagtagaggctacttaggtttgtggagcatggtgtgcgtaggggcagtgcttttaactcccttcaacctggcagtgtgtctctgctacagtttcttcctgattcccatccctttatcctcctgaacacaagctggcatccaagaccgcctgggaccaccccgggaaagacctggagagctgatttcaatattttctctcttcctggtaaaatatttattgaaactgtgcggagtgagaagtcttcctctggttcagaaattgtctgcctgtaaacacactgacctgggttgggggcaccaaacgagactggagaaaataaataaacagcacattcctattacgcaggagccaaggcttcaggggagatggcaggggtgagatgggagccacccctggtgtacagcacagacaaaccccccgctccaaaggatataaaaaacgatgactgaaaaatgttctgtctctttgggctgtggacatgtttttagtggttaatgtttttatggcaatattcctcgggaggaagaaaattcctgcaaagatggactaacagaaaatggttaagaacaaagagccagaaagagaagtgatactgacccttcccccccaacaccaccccccataaaatgagagctggggaggaggggcaggaggcagggaaaggctctcgaagctgggcagcccagcacctggggcactcaccattgacaagcctgtatttctgggccaggagggcggcctgcagacttttcccactgcccacaggcccgagcagcagcaccctcggggtgaacggggcattagtacgatggttgctttggacataggtcagagctggaaagagaggatatgaggataataaacccaggtcctagagaacaggaaacccgcttgcagcccctctgctttgactcttttaacggcagtaactctttttctctttcacagcaccatggaagccctctgtgcatctggcgaagaggcagggaaaagaattacgtggcaggcctgggcaccaaggcagggagcgaggagtgaagtccacagaagccaccctggagcgccgccctggattcctctcaacacaggcgtctaaacacgtgcaggtgtctgcatttccttccaggctgaactagggctggctgtgttgcagttgggagactggtcccaggacatgatagcactctctatagggctggtggcttttcctactgaatcgggctgagcctcccaaccggaagccccggaactaggctggtctcctagaagtgcacgctggctttctgctaggtgcacctgaatgtcagacacaggctttgataaacgcatccagccacatgggggcccagtgcccagggacttctaaaggactcgaattggagagtagtttgtgcagctgcactctggtgacaccaactttgttgcgactctccaaagaggtagtgatcaaagaggtcacaggagtggccagatgtagctgcatggccctggcctgtggtgtgcccctggcatttggtgaacaaagaagtgaggagatggggtgagtgtctccaacaatgaggccacctgcaccatggggggcaccggatgccaagaagccacagggcaaagctactgaacatcaaaccaggtcacctcccgctggagctcagaaacagggagctgtgagaaaaggctaatgaggctgtaaaggcagcatttcgggcacctgaggcaggagagatgcccacagatgaggcacggacctgtgccagcccccaccccagcgttcaaaacagggcatccttccccagggagaccttccccctcctgccaaggccccagactgtcctgtgcaaactcagccaggggtggccccgttacaccttcctgccagtctgcctttaccaatgtgccttgcggtgggtgccgtgctgggtgaggggccaggccatcgtgcctccttcaggaacatgccacccaggaaccaggcaggttcctcatcctcagcactactgacatctggggccagaagattctttgttgcggggctattctgggcactgtaggatgttgagaagcatccctggcctctacccactaggtgcctgcagcacaaccgcaaggtatgacaaccaaaaaacctttacagacattgccaaatatccccggggttgcggtgggggcaaaactgcccccgattgtgaaccgctgggatatgttcattgtgaaaatcctgaactctcaaatctttgctggacttttaaattggaagggtcattagagatgcacagtcccctctttttagaaggcagagatgagttagaatggacttttttccaggttgtgatcagcatcatcaatggcatgtactaattgctacgacaaatactctataggcaccatctcttttctttggcccaacaatcccatgagggttgcgttattcatgtcccattttacagatgagccaattaggctgagacttggcagagctggggcaactctcccaaaccacctgccatgggtaccattcctccactgagagaagcccaaaggaagctactcaggcgaggctctctttattctcagaccttccataatcccgtgcatctgaaaagcacaaatactacaggcaaagcagcctgcttacaaatgatgcttaatttacagtaaataactaagttaattagaagtaatgatcccccagacagtctcaacatctaattattctttttaaaaatgtgtggttgctggatgcactgcagagagattagaaaaacaacacagagagaattctgcattccaattttcaatttatctctctgcattattaattaataataattaatattcagacactcacatttttatttacaattccaggcatgaattctttatgaacgatcatatgaacttttaaatttaattaagtaatttggaagtaattaatgtgtaaattcagaatcatggcataagataaatgttgtggttgtttatcttaagagtgcagtgtttgttactaatgacccttccgagatgcaaaatcactggaaaattataagccatcataagcctggcatttcttctttaagtagcgacattttctactaacccacccgctggctgattgctcccttcagagggcgaggctgttcaatccacgccggcaaacaccgcatctccgagctcagtgtagcaatgaggtttaagcaccgagtctaccagcaggagaaggtgctgggaaagtcagcagggaagggcttgagggagctcaaaaccacttccccggcaaaacaggacttttcttggagagttttgagagaatatatgaaaaaaaggactttgtaaactgtcaagtgtcttaaatatctgtgatgttcccatcgtaaacgcttcatttacccaacactgtgtggaagggtaattttgagacgactggattttgagatactgcattttgagatgactgaagctcagcaagacttttgaaaaggataatacagctgtttggggatagaattattctaccttgcccttgcctttttgggcagggtgttgaacaatgataggagctatgacgactgatgtttattgaggcttttctctgtgccagaactgggcttgtggctgtggacacgtgatttggagaatcccatttaatcctcacctacgcctgggaggagggcacaagttttgttcctattttagcgatgccaaaactagggctccgaggagttaggagaagtgccagaggctgcacagctgggctgcgtcggggctgagatttgaacaggttgctcagctcagccatccccgcacctcgcacaggctgcccgcagtggctcccgagctgctgtgaacattggccattgctgtggacagcaacgcagtgccaggcgcggggccatgtatctccatcctaaatgaagcataccacctgtgctgtgtgtgtgtgttttattgtgttgtgtgtggtggtggtggttttgtttttgtcttaatctttatatattttttctttcctctccctcaaggtcaggctcaaacttcttgctaccatgtccctcccaccccatcccttgcctctcctcctcccgaccccacgaccaccaaatctgctgtgggccagagatgtgaccacatctgagtgtgggacattagcccagggtctccaagtggggtacccccaggggctctgcacacatgcatttctgggcagggaacccgggtcatctatgtcttgacttccagggtcccaggcatgtcccagacactggccactaccagaataagggacaaagtggtagaaggcacagcgagccccgcccttggccgtctgtccagggtggggctgcctgcttgtgtttaccctggtagaagacgtccacacatggctggtcagcactgatgactttgaggattttggggtaggagggaatgaccctgacgatgttcctatgatactccagcagtttctgagccgtctccagctctgagatgtcctctggcaccatgagacggttctggatttcagattcgggtggccagtcaaaggtggtgtgataaatctctacaaggagagaggtgcacagttagaaatggccatgcaggggccctgtgggcgctgctgtgcctggctggggtgcttgctgtcctggaggccaggccctacacattcctggggtgtggctgaccacggcaggacaccgttgctcaacaccagcacttccagctactctgagcctgctcttaactattattcttgttacaatacaagaacaggacccagggcaagggctgccgtgaacttctgagcacttactctgtgccagccactctgataggcacctgcagactcccatttcatcttcacagccatcccatcacccattaggttggtattttcatcctcaagtacagataagaaaactgagtctcaggtatcccatgtctacagccagaaagggacagagttagggatccacaaacccagctctatctgccaccacagcgtgaggcccggaagatcaagggcagtcccgtctccccccaccctcccgccagccccttgctgaactgcctggtcttcaaggcccagttcaagggccccgtcccctgcaacacctgccaattctcccaggtaatgctcatgcctctctctcctgtataaataccaaagaataaggggtgtcaagggggcacataatttgtcccagggagaggcagacatgtcccctggctcctgtgtgggccccaagcccaggtgcctggcatgaccccccacactctattctggttctgccacaagaaagtctcctcctttagcctaaacaggcctccatttcctcatctaccagaatgtacccttgccagtgtcttccagctcagagcccagcctgtggcagccttcctcgtgtccctctgtgggtgcccagagcagaatgcgaggtcaggaaatggtagacgggctgtcatcaccatggactctgaaaccccatggggctgggtgggggtggccgtagccatacctccagtttgagggtcgattctcttccccaagtttctctcgatcaggaccgtgtctggagcactcagcacaactgggcagagaagaaaaggagcaaaaccaggcatgtcgggcagcgggtgccacacatttgaatatcacagaccaatacttgctttacgttttttgcttttctgtataatgacattaaaacaacaatcatctcccatccccgtgaattcctaagagaaaggtcttctcgcacccaaacacaaagagtgtaacgttgggacagagcacggcccatgacggaaagttctgcctgttaacaatttccctcgtcacagataacgccacaatgggcatctctgtgcgcactaaatgcttgcacagcattctatgctatgcatagaatatgcatttccttcctgagacaaggaatcgccaggctgaaaacgaaaccccacttttcttaagaaccagccctgaatatatttagctctgtgaaaaattcagttgtgctgtcctcttccttgctgggtctcagacggtgcctgggctgaggtcaggagcaggcagcatgagcggggcgctcactggccaccccttggggctgcagctctggcaggtgggggacccttgggagctactcactgacgtgtctgggtgtgatccccagggtctggatcctcagagcctgctcacgcgtctcagggatgccatccagaatccagccctagacagaagattcagagaggtgctcatctgttttgagttttagattttttggaattattttaaaaggaatataatagctttatagaaagactagaacttttaagacaaaaaaaatgtttctgatagctacctcacccttctttaaaaactactttgtaatatattattatattcccttccgaatcatatcttggtgattataatcataacatatatattttacatcttgatttttttttttttttgagatggagtttcactctcgttgcccaatctggagtgcaatggcacaatctcggcacactgcaacctccgcctcctgggttcaagcaattctcctgcctcagcctcccaagtagctgggattataagcatgtgccaccacacccggctaattttttgtatttttagtagaaacagagtttcaccatgttagccaggctggtctcaaactcttgacctcaggtgatctgcccaccttggcctcccaaagtgctgggattacaggcgtgagcaactgtgcctggcctacatcttgatttttttctaccacacaatagcgaccacaagcatctcttcatatctgcacagctcctcattgtccacattatcaacggctgtgcaatgtcccaccaagagaatgtacacagccacttaactatgtccacaaatgaacatttcaactgcgggcagtgttcactatcatagataatacctcgatgaacatctttgtgcatctagcgctttccacattttggataatttcctaaagacagtttctgagagattcctgagaccagggtgaaaacaaaaccccacttttgttttcattttctgccccatatatctgcaggaacaccccatttttcttaaaaaaaaaaaccctggacgatgattccggtttctactctgcggctaacttgttacaggattgaaattcctcacccatcagccccctcttggtacagctagggaactggtttagaggtttatttttactatttatttatagagatagagtcttgctacgttgcctaggctggtcttgaactcctgggctcgagcaatcctcctgcctcagcctccctagtgctgggattactggcgtgagccactgtgcctggcctttactaactctttaaatccaattgtgaaagtaatatacaatcattgtacactgtgtggaaaatattgaaaagctgaaataataataagagtcactggtaacacctcagacccaaacaagccactgtcaacattctggtatatctccttccaagcagcaagtgcagataccttttttcccggtggctgggggttgtggggaggggaaccacactgtacacactgtttggtaatctgttcttttctagcaaaaacatttcatgaacgttttcccatgtcacaaagtgctccttgcatagaagttttcacagctgcctggtattgtatgaattgacctgatgttaactgatcccatattgttgctcatattgctcagtttgactccagttttccaccattataaacaatgttgtatatgcatctcgatgcctatcaaacatcctcagataaatttctaaaagttgataccttcttttacgacttttgatacattttgccacatcgctctacaaaatggcccactagtttatgaatccaatggcaaagcatgtttccttgcatctctgccaatgttgggcattatctaggggaaaaaaatctgtccagcaaaatacagtataccactgctgctttaatttacatttctttgatcattaatgaggttcagtattttttccatatgtttgttagctatttggatttttttttcttttccaaaatgtccatttgtgtcatctatctactttccccttggggtcgcatccttttatttattgacaacagctctttacatattaagaacgtgaacccattttggcaaacactaccacaaaccctttgaggcaaactatgttgccaatattttcagcagtttgtcttgcagccttttcattttgtgtgtggtgttgcttttaacacaccagtttgtggccaaatgaatcgctgctttcgtctttggattctggcattgtgtggatgcataaaacaccctcccccctgaaaaagctgatacatattcacttgcctttaaattgtgttcttgtgtttttactctttacatgtaaatagtaatgatttgtgtaatagggctgcattccagtgtgcgaatgatatagggctgtgatctactctgtttccttatggctcaccacctgttccaaactcacccacaatacagtctatcttttcccctctgaggacacttatcacagtctaaatgctgatacgacattggctctggcctctttctgcctgtagattgttaaattctttttatttaactgtttaaattgttgttttataagttatcgtaatgtctagtaaaatacgctctcccttcttttttttttcaaagcaagatctttcaggtaaacattaaaaatattttgtcaagttcccaaatagaaattccactgggattctggaacaacattaaatgtgtagatcaattcacgacaaattgacatttttacactatcaagtcaatgcattatcgtctcatgtgcttaagttgttttttatgtccctcagcaatgttcacaataaacaatttctaaagtcctttcaagtcccgtgagtctagagttacacacacacacacaatgtaatgctttagacttgatgtccaggtacattagtaaagggagctttggaagagactgaaagaaagcagcgagttgcttcaagtctccattgtgtaggaagcggggtcaggcaactgggagtcaacgctgggagcccccgcttgctgtagagccctccctctcagccactgggagactcagttgctctaaggtcagatgacggactgacatggacggactcagcctccaggtcactcacgtccatatcacctgatcgacagacacagtgtgggcgactgtaagagatgtctttctttaaaaacaaaccaaaaggtggtctgggtgcagtggctcatgcctgaaatcccagcactttaggaggccaaggcaggaggatcgctggatgccaggaatttcaaaccagcctgggcaacacaatgagacccccccactctaccgaaaaagatttttaaaaattagccaggcgcgttggtgcacacctgtaatcccagctacttgggaggctgaggcagaaagatccccttagcccaggaatttgaggctgcagtgagctacgatcgtgctattgcactcctgcctgggtgacacagtgagaccttgtctctgaaaaaaaaaaaaaaaaaaaaaaaaaaaggccagcatttcttccatattaaaatatttaggttcccgtagcctccactgacatttaaaaaaaaaaaaaaaaaaaacctaaacaaatttacagcctaaagactgttggaaaaatccagcaagctttcattaatttcttgaattatacaggaagactcacagccacggaacccctggtttctagaactaatgaagcaaaagtgcaaaaacaatttttaacagtcttttgctccctcaagtccttgttatagccagccaagcgccgggctgcagctcttagaaagagcaaacatctacagacgtgagcaacaccagcagaaccaggagacgcagcgtctgacagctccctcacagttctggaagccgaaccaacattttctgaactttagctaaattcatacccccttatttttccttcatttggacggggagggattgtgagcccattgattgctgcttctagtacaagggctggcaattctgttttagtccctttttgaagctggaaggttggaactccatctttgctcagcactgaaaaaggcctctgcttttaatattgcattactgagcaatcattataatctcacccataaatttgcagcagatatcagtatgtggtccaaggcttttagaactattcaggggaacagctctcactgacttttcaccagagaaagcgggacttccaattacacaggaaaagtgcagcaaaatgaggaacatctccctaattagcctggcctcactggagtgtcattctggtgcagatgtgaaaatctaaaaggaagaaggtggggggctctggagtgagccctaggccaccagctctccaggtctgctctgagctggggaaatggtacgatcacctggggactaagaaacaaggtccccgaggaagccctcgagcagcacccaggccccattagagccaccccccactgtatggagaaggcagccatggaggctcttcctctctgcgccagcccacgctggtccacactggtccacctggaagggagggcgccttgaccaaacctctgttgaaggcgggtctgtcctacggcattctcaagatgaaagctgcaggcttggggctcagaaaagatcttctttcccagagctcttgcatttaaaggggttatttgcccagctgcaaaatgggctgcacgttcacagggaagcagcaattttggctgggaggactttaatggctacaaattctggcaaagcaagaagtcataaatcagtaaatagcacccgacaactgccatgatgggacattaagacattcccaacaagcctgtgttgcgaggttcgcgggtctcacgtccaggagtggctggatgtggaggtatcagtcaatccctaattagaatacattatccatcttcctgacacttcagtgaaatgtctattccactctgagctgcagctttgttcagagcaggttaattgatattctgatgccttcgctcaccgtacccccgtggctcggttctgttttatcacacatcaaaaaggccgtatgctcagggcactccaggcaccagtgcagagctggaggtctgcacagctgcgaggggtatggtatcacaggagggacaagcactgagcagatgtcacagatgaaaaaaaagcaaagaaaagacgccagtcagcctggggaacttggcgaggcccagcagagcacggcctgatgcggcacgagccgtccggctttgtgcgaacactggcctcttttgccctcctgactattattaaagcgcaattagcaacttcacatgggaaggctctgttgccctctgggcctctgcctttttgatgcgttgcctttccgctcctcccctctcctcccaggaccagagcgtggggctccctgggtgttttccccagtcctgcctctgatctggctcgcagctccgactgcagactccaccggaggcattccctggagctgcatgctcaatctctgcagtcccaacgaggcaagctgaggctgaagacttggactcgataaatcagtttcgctcagttccaagtctgaaccagggcaagcctcacaagaggcactgcaggctgaacgcggcctaatgtggtttcccaacatagaggagagagattctgtcagccaggaaggaaatgcatcttaaaagatccagtttgggacagtgatatgttctaaagccaatcggtgagaacaatgagactaccttgatgaacataaaaaaatctgacatcacactgtcccaggagcagttactttggtttatacaaaaacataaaaaccttagcctgccacagaaccctaggatgccgtccatattcaactcacctgaaagatgactagcaagaatttttatctcaaagttgaatcccaaacaatatgcaacccctgttagcactgaacgtggaatgcactgaacacggaacgttagtattccacattccacatgtatgactgtagcaggaacccgttaccccttaacttgctctgattcctccacctgatcaaggtgaggtgtgcccagggctttgcctgacctttttctgggcagcctaacagtgattatgctcttacaacgccgaaatatgcaggagtgatttttctaaacagagttgaattccacccttgataatcaatgatacatgcgtggtatttttatacaaacgtgcagatgcggggatatcattactcctagatgtgcagcctacaggccaatgatctctaggatatgaaaacctggtaaagcccaaatgcaggcattcaagaggtgcctttttttttttttttgagacagagtcccactctgtcgcccagactgctggagtgcaacggcatgatctcggctcactgcgaccttctcctcccgggttcaagtgattctcctgcctcagcctcccaagtagctgggactacaggcgcatgccactacgcccagctaatgttttatattttttagtagagacggggtttccccgtgttagccaggatggtcttgatctcctgacctcatgatccacccgccttagctgcccaaagtgctgggattacaggcatgagccactgcgcccggcttcaagagggtttttattagttcctaaatagttaaaaaaaatttaaattcctatcaagtatctatggtgcccctgaagccactccatggaagaagacacagtttgaagaacaaattgttctgtccccagatgcaccagtctaccctagctctgaggttggccccaagatagccccctgcagagataactcactttggaggttcacatttagttctccaagtcagacataatgtgctttagatgaaagtaacagacacggataacccagcatccagggcccattcccctcaaacactttagaccatgtctgtggtgtagacccacctgtctagaaacaagattagccctggaaagtatcagtttcttgtaacggcggaaagcagtggctttggaaccagatgacctgtgccacagccaatgtgtgactttcaaccagtcacttcatcccctctggcctcattctcctctgcacaatgtgaataatcaaaatctagctcacggttgatgaaataattaaatgaggattataaacaaacagaccaggcaccgtggctcatgcccataatcctagcactttaggaggccaaggtgggaggattgcttgaggccaggagttctagaccagcctggacaacacagcgagaccccgcttctacaaaaaaataaaaaattaggccaggcgcagtggctcacgcctgtaatcccagcactttgggaggccgaggtgggtggatcacctgaggttgagagttcgagaccagcctgatcaacatggagaaaccccgtctctactaaaaatacaagattagccagacatggtggcgcatgcctgtaatcccagctactcaggaggctgaggcaggagaatcgcttgcacctggaaggtggaggttgcggtgagctgagattgagccactgcactctagcctgggcaacaagagcaaaactccatctcaaaaaaaaacaaaaagttagccaggcatagtgacatgcacctgtagtcccagcttcttgggaggctgaggtggaaggatcacttgagtccgggagttcgaggctgcagggagctataattgtgccactgcacttcagcctgggtgacagagtgggaccccatctctgaaaaaacaaataacaaaacaagtgtagtgcctggcaacaaagaaatgacccaaagttaactagttttatcattataattttgagaaaggtgaacgatcttctttttctctacctacttccaaggagtcccacttaagtttgtagaacttaatattaaaaaaaattgtttaaaaaggcaaatctctgggaaacaggagcaactggcattccaggtatgaactgagggaagatctttaattaaggaggacttggggtagacacatttctctttttttgaaactggggtcttgctatattgcccaggctgctctcaaacttctggcctcgagtcatcctcctgccttggcctcccaaagtgctgggattacaggtgcaccaccacgcccagctgggacagacacatttcaattagaatgcgggggtctagtgagttaacagctactgtggattcaccccaaggtgggctcacgccatttgccatcacttggccagctgccctctctgaggggagtttgcctgtcctctggaagcccatgtgactgtttccttatctgtataacaggaatgatgataatagtacctacacttcatagcgtttagggttacaggcaacgatgtacctaaagtggtggcacaacgtctggcagatagcaggtgcttaataaatgtctcctggcatacacaggcttttcatagttgacaactcatttgaaaaacagaccaaactcagcctaagaatgggagaacgggccaggcgtggtggttcacgcctataatcccagcactttgggaggccaaggtaggcggatcatgaggtcaagagatcgagaccatcctggccaacgtggtgaaaccccatctctactaaatatacaaaaattatctgggcgtggtggcgggcgcctgtaatcccagctactcgggagactgaggcaggagaatcgcttgaatcttggaggcagaggttgcagtgagctgagattgcgccactgcactccagcctgggtgacagagcaagactccatctcgaaaaaaaaaaaaaaaaaaagaatgaaagaatgaggagttggcccccttctgctctgcccttctgctgtgggtgccctgctagctctcgggagcagacgtggcacctctgactctctgctcagcctgcgaagagaagagtgatgtggtcagtacttctgggtccagtcccgttcccatcatctccgtgcctctcaatactctctcctgctccaaggtctgcttgcgtctgctcaaacctcaggccctgtcctgcatttgatcatctctttttcctcttctactgcagtgagagggatgatctgaggcatcacacatccacagagcatatcggaacacgcgttcctgtccacatggagtgctacggctctgtatgcagacacatgatccacacgtgcccttaagaagcccatatcacaccaaccaaccaaccacgcctcagcatcagggtctcttacagaaacacccacaaataagggggcacaggaggtgtgctcactgtgctgtgcccggcacctcaccaagccctcagaagccctgcctcgccgtgatgcgggccatacgtttcctgagtggaactcagacctccacttccaatcccctgcaaagctaactgcatctgtatttgaggaacacacagccagggcctcagcagagctgtggatcaataaaaccgcactccttggaggaggcaagtgacatctataaacccgtgagtgtcaaaacaatggcaagaaaatcctgtgttcctactgtcagtgggatgaaagtggtgtaattaatgccagcccaatgacaccacaaggagaaataaaacaaacagctggtggttctgtggaccagcatctagctcctccactccgttactgtttccactataaaatactgactcatgttatgggcagggaagcataaatctaagaccaaagaggaggaaaaaagactatagaaacccaccatgtaaattctaaacttttggctccacagtcaaaagtgtgctacgtccgctccccctttacagtgaaagaaccaagtttccatgatattacatgagatctaagaggagtcaacctgggaacacaaaatagaattttgcatttcatgttcagtaaaggaaacacccccggccagtacagtcacttttggggctgggggcctgaccttgcttcccaagtgcatcagagacctgactccagggatctgcggacatggtcaaggttcagaatggtccaggtgttgcatctgatgatggcattcttactgtagctccaggaggaagattatgcagaagcagacattttgaacctgatgcatttctagaaggtcagtttttcttctaggtaatgtatttatccctcctttgggtcagtgggtggggctcctgtgctacggcctcatccgtagaatgacagcagctcttagaacctgcctgttcctgtcagccctctgttctgagccacctagaacatttgctggtgcacagcaggtgccccagaagtcttagctgttgaaaacatcataggacagtcatgcaggttcaatgggaaaatgcatcacagtgtgacgtggtgttcggcacatatcaggggccagtaaatgctagctgagcattctgtgtaccttattatttttttatttttttgttgagaccgagtctccaactgtcgcccagatggagagtgcagtggtgtgatctcggctcattgcaactctgcctcctgggttcaagcgattctcctgcctcagcctcctaagtagttaggattacaggcgcccaccaccacacctggctaatttttgtatttttactagagatgaggtttcaccatgttggccaggctggtctcgaactcctgacctcaaaagatccacccgcctaggcctcccacggtgctgggattacaggcgtgagccaccacgcccagctgatgtgtacccttatcttgatggaccaattttgctcttcaccaactgtgtcttggcttagttctggccttcattttccttctttcctgtctttaatgtaacatgatcacaggctcaatgagtcatggggcaaagtaacactcttttaacacactgaagcagagacccgttcatattccatttaactgatcatgggtcctggtggacaggctctgtttccttcctatgcttttgatgggagaataggaagacttctcgaagaggtgctggggaataagaggcgatgtctagaatgcattagccaggatgcagatggggacagcatccctccgcaggctcctgctcagcagcaccggggaggatgcagcaggcctagcttttgttagtcacagtgtcgctttgactccggcaggggctctgagcctcacagttaaggaagaagaatgaggagacactgtgaacagaatgcagattgaggaggtacctcccaccagttgagcactgtcttagtccgtttttgcggcttatgacagaatacctgaaactgtgtaaattgtaaagaaaacattttttttgccgggggggggggcgcagggacggagccttgctctgtcacccaggctagagtgcagtggcgcgatctcggctcaccgcaacctctgcctcccgggttcaagtgattctcttgcctcagcctcctgagtagctgggactacaggcacccgccaccatgcccacctaatttttgtgtttttagtagagacagggtttcaccatgttgcccaggctgttctcgaactcctgacctcaggtgatccacccgccttggccttccacagtgctaggattacaggtgtgagccactgcgcccggccccagtcacctcttaaaggtagtactatggctctcaatgctgccacattggagattaaagttcaacatgagttttggagaggacaaacattcaaaccaaagcaagcatcaagaaagcaaattcctgctgcagtcacactgaaggtcccttccctcacagcccagctccatctccaaaggagtgaaccgagcatctcacgtgcttggcttcttgcattacgctcgcgtttggcaacattttgaaccattcctaacctccagagtggtgggactcaatcccaagtggacactcacacacacacacacacacacacacacacacacacacacacaaggcaagtgaacaggcatgaggaaggcagtctgcagctggctcggaaatttcactgatttttttcctcaggcactacactgaaaagactgctcactctcattcatccaggtatggggatataatagaactcacttgagtggtggtttcaaaagtgcaccacaggccaggcacagtggctcatgcctgtaatcccaggaatctgggaggctgaggcaggtggatcacctgaagtcaggagatcgagaccagcctggctaacatggtgaaatcctgtctctactaaaaatacaaaaattagtcagttgtggtggcacacgcctgcaatcccagctacttgggaggctgaggtgggagaatcacttgaacccaggaggcggaggttgcagtgagccgagatcgcgccaaaaaaaaagtacaccatgatgttgctggtagatcataaacccacccagaaagtgtccaggactgttttctaacacaaagcccaggtatgaagaagtagcagacttctactcataagggatcctcaaatggccttcacccaagtcatccagcatgtaaaaagcatcaactctaagtggacctccgggctgggcacagtgctaagtgctatgcttggatcgtcacattttaatcagacagtgagacagctgttacttcagagcatgcgccgcagcacctaaggccatgctgcctgcctgtgaattacagggcgctctacatagaaaagcactgcagcccgagcaggctgtccacaccagtccctgtctgagtgtccctcgctgctgtctgccagcccagatattcaagggtcagctcaggtcagcagatgtgaacccgagccacgtgtggagcccataagaatcacattcccggtgcgtgaaggcctctgccttttgatgaataataaaattctccgcacatgacgagccgtcataattgggcacaagtctttcctttgccccctgcagcggcgtgggggtagcatccatacatgaaaacatttctttttttctttgccagatattttccagtctgtgatattccaaatgtctggtgctggtgacataaaaatgcctttgtcagaaggcctggcacaaacctgccgagtccagctgaagcctgacctgccagtcaggtagccaggagcctctgcgtggtggcctgtaaaatgccacactgacctggcctgtgggacgtcaaccaaattccttcctccatctgggcctcagtttcccttttcataagaggtttttgtgggatgatttctgtagatggctttttaaaagacattgataagacaaactgggattcatccaccaggtgtgatcacttttatgttacacatttatttaatgctttaaaatcaagcaccctggcgcttgattcttgttacagttgattagaggaatagaggaggaggagacagaaaatctcctggcataggagatcagattggaagactggttctcaaaaacctgaacccggggtcccaaggggggacctccacccttagggtgcagtgcttgaactttctcaaggtgtaggagtccaaggccaaatgggaaacttgaaagcactaatgatgggaataattttagaatacaaggaagaagtcgctaaacagatccaaaattcacagaaaacaaagctagcacactggccaaaacaatctccccaaagaagcctgaagacaagtatgttcctagtgttgaaaccattattagggcatccggatgtgactggatagggctgctggattttaaacacctttgcctccttgggccatgtgcatgttgggataagatttcactgccacggtggtacagaactggggaattatccaaatggcattgattgattcattattgactggttcattcattcattcattcattcattcattctataaatatttacccagcatggagtctctgccaggtatcacatgaaagatcttgcattcctactcctaactatgacagtgcagagttggagagcagaatgctgtgagcatgtgtaacaggcaggtcggcctcatctggggctgggcaaggccaggggaggcctccctgaagaagtgacttgaagctgaggctgaggaatgagagcagttttctagctaaggggtggggttaagagcactgtgtattccttttccactgctgcataacaatcttagtgactgtagacaatacagttattatcacatggttttcaaggagtctgagcacagctcagctgggtcctctgctcagtctcaaaggctgcagtcaaggtgttgaccaggctgtgttcccatctggaggcttgactgagggagaaccctcttcccagctcatctggattgttgacagaatccatttccttgctgccacatgactgagggctccggtttctcgcttgctaggggctggaggcccctgcagttcctagagaccagccatgtgggcttctccaacatagctgcatacttcatcatgccagcaaggaggatctctctctggtctgctaaggcacattcttacataacataatgtagcacaggagtgacatcccctcacctttgccacattcagctggtcctgcccccactcaaggggaggggattacataggcatggacacaagggggtgggaaatcactgagagttgcttagtgatatagtttggatatgtgtccccacccaaatctcacattaaaatgtaatccccattgctagaggtggagcctggtgggaggtgtttggatcatgggggcgggtccctcatggtttggtgctgtcttcacaatagtgagttttcaagagatctggttaaaagtgtgtggcgcctccccctcccactgtctctctcttgctcctgctctggccacatgatgtgcctgctcccccttcaccttctgccgtgatggtaaacttcctaaggccttcccagaagcagagcagatgccagcaccatgcttctcttatagcctgcggaaccatgagccaattaaacctcatttctttataaattactcagtctcaggtatttctttatgcattgcaagaatggcctaatgcaattagggtctggcagctgcccacaaaggcctgagcagggtgggtgcaggttgacctggagaaaggtggcgggtactgagtgggtagatgagagaagtccagggatgaagctgaaccgcaggcaggcccaggacacacagggctcctggaagcagtggagggtcacaaccacatttattttaaaataacaaatgtttctctatgtttaaagtcatcctcagaagggtgcactttcaagaaagtgtgaacatcagttgcctccagggaaggaagctgggtggctaaggaacaggagtgaggggggactttggtgcctttggaaccataggaatgaatatatcatggtaatgaaataaattcattcattctttaaaaagccatccttccagcagcaatgtgaagaaagagttgggaagaaaccagggtagctgtggggagatggatcaggttccaaataaaggaaagggattcttagcaatttaaataaaatggagcacaaatggtgactatggtcaaggtaaaatttagaatctctttggtactgagcctttccccccaagtttccagaacttactgtcttatgtcttggcttttctttgccctacaggggtagtctgaggattcgggcacattctcttgattgtccctaacaatggctaatgggtatccaacaggtagagccaactccttttgatcgttccaatacagagtgctaatttttctttctctaatgcatttgatggtcacttcaaaaaaaaattcttcaaagagactgcattagaccaaaaaaaaaaaaaaaaaaagaaaaaagaaaaagaaacgacccccctgcattaactacagaatcctgatgggttatgattgcgttatttttccctgaacactattccctgcattctttctgtgctctaaattaccaattctagtccctgtgtagctaaataataataattaccatataaatgaatatgcatatgtgtcatttttctccctaaaagcaagaaagcctgtttattttggatgagggtttgttttgtttttgaacaaccaaagcacataattagaagtctaacctcttactcttgaaatcctgtctccagcgggaagagatgaaaaggcaatggatgccccttaaaggttagaagaaagtttaaaacaaattgaaggagatatttctttactctgcaggtaacaacagcgtggacatgatcagaatcacagaactataagactagaagggatttccatgctcaagactagaagggatttccatgctcaagtccaaccccatggttttatagatggaaaaactgaggcctaaggaagtgaagctctcaccagagtaacacgctctgtgccttcctgagatgcaacctttgaaacaagaacagtggccaatagtacaacactgtgtttgcatctcagttctgggatttaattgtgggatcttcagcaagatacacaacctcttcaaggcctggattctgcatctgtgaaatagggtagacagcagtgccacctccgcaaggttgctgtaaggactccacagcacacggtcctgctgccaatgctacactcccaatcaaggggagtcacccagaatgtaattacagcctcttgcatagtgcaaggtgcacctgcaatgtcatgtagcagataacatgccagaccaggcgcgtagactacagctaccaccatcatcaaaataatcataataataacacacattataaatactcagtcaatatattatttataatacaatgtaatcacatatagtgtaatgtaactaataacgatgtcaattataattgagattttaatttctaacaatagacttcatcatcatttttatgatggtgacttgggatgcatggtcctgtactctgtccacactgcaggtgcactatgcaaagaggttatgcagaccaagcttttaaataagctcaggaagaattcacagaagttaaatgcatatttgaaagactattctaggccgggtgcagtggctcatgcctgtaatcccagcactttgggaggcccaggcgaggggatcacttggaagtcaggagtttgagaccagcctggcccacatggtctctactaaaaatataaaaattagccgggcatggtggcatgtgcctgtaatcccagctactcaggaggctgaggcaggagaatcgcctgaacctaggaggcggaggttgcagtgagcagagatcgcgccactgcactccagcctgggcaagaacgaaactccatctcaaaaaaaaaaaaaaaaaatgactattctagatcactgagggcatgtttgggatatccagctgcaaacacagagagaatcaccatattttccccagaaactatcactcagtgaggtagaaattttttaaaaatcacggaaacaaatctgtccaggcagctggatcctgtgtgaaaactgtgcagccttgttagattctggagtggggaaagaagggcagtgcggcttcaagggcgtgtatatagccagtgggacacacagacgatcactggcagcccaccctgaggccctgcatctctggattctagatttccacctagaatccagaatgcttacccaccagaaacattttcattggaatgctgtaacttgtaaaaattacttacacgaaatagtactgtttcaaatgttttgaggttggaaaggagagagactttgagggttgctcagtggtatccagacacccaccctgggccttctgcaatggatgtgtggggtggatggggcagaggggcccacagatgccttggccccatgccaagcctctcttccagctatgaagttcagatctgcctctaactgacgtgactcctttgcttatttatctggtttattgtctgtctctccatgactagaacttctgttccttgagagcaagacgtttaactctcttgttcactgctttggtccctgtgcttagcaaagtgatttgttgcatgagagaatagatgaatgaatgaatgaatgaatgaatgaatgaatgaatgaatgaatgagtacttttaggaaacactgactggggagccgggtaggccaacaaaccatgacaaggcttttggtcacgactctagtggaggaacatatcaggtggcatggggacacgttgggggcctgtgaatggcacaaaacacgacagggagtagataggctttgcccagcctttgagcttctgtcctgggctgcatagcacagccctggagcccctgggtcagagcgctggccctgtgcaccatgtgcctggtctaccctggccagccctgccgcttcccccggtgtggctctgggcgtgcctcaggccctgcagctacaacatgggcacaataatagtaacactggccatgtagggtcccgtgaagctggagaagctgctgggcgtagtgcctgatgccaggctcagacgcatgctccattcaggtctctggcttctcccgggccgagatagagagctggagcagaggctctgggcctgcctgctctcctgcctgcctggatcccagagacttctgccttccagtggtcagcaggccagctcccggcttctgctgcactaaggcagctggttgaagcaaacactcttgaccaggagagcgggccgggggaagagcggcccagacacagcagttcctgctcaagttcctgggtcacaggtggtttggggatcatagcatcttcaaaggaaatctgaaaagggaaaggcaggtcttctaccaccaggcgtggggaagtcctgctgcctttgctgactaagacagaccgtggcgccatctccaccgggcctttcgtttggcaggggcagtgatggtggctcatgagtatgccacattttttaggtgcgtgttattcctgaggatatgaactacatagtttctcccttcctgtgtgcttagaacgaatgctcatcacactgacagtcctggttccaggaactcttggcatattgaatttgaaacactgcctgatgggcaagaccatatccagctgtgctttcacagacagcccccacccctgctgagggggtccagtcctgggcaactaaggtacaattaagccaaaggagtaccacccccctatatttgaccaaatttgatgagtagctatcatgatgaaaaagagaaaacagcttagctttaaagatcaaagagagccaggcatggtggctcatgcctataaccccagcacttcgggaggccaagacatgtggatcacttaagcacaggagtttgagaccagcctgggcaacatggtgagaccttgtctctacaaaaaatacaaaaattagccgggcatggtggtgcgcgcctgtgatcccagctactcaggaagctgagcaggaggatcgtttcagcccagtttaagatcagcctgggcaacattgggagaccacgactctacaaacaataaaaatgaaaaacagatgggcatggtggcatgtgcctgtagtcccagctactcaggaagcggaggtgggaggattgcttgagcccaggaggttggggctgcagcgagccatgaccgtgccattgcactccggcctgggcaacagagcaacaccctgtttcaaaaaaaaaaaaaaaaaaaaaaaaaaaagattgaagagaagaaaggaagactcccttgaatgcttccagcctggtgatctgctatgcaagagtctaatccaacttggcaaatgcataagaaataatggataatggattaaggcacacagcattttgtatgggaaaatgctggcccatttccagtcactcgggccatctttccctcccctttaatgctctgccaaaagattgtttggcacttcctaggtaaaagaggtgggaaaccttaaaaatagtgaccgactgatgggtcagttttaggaaaagttcccgtgaggttggtttgacactctgagttaagagtgtgaaattggggtaaaggactgggttttctggttcctgcctcacttctggctgccattccctccagcctaagacggcccctccacagtccactccagtccccttcactagaggcttcaggaatcacttgactctcccgccctggtttttccatcacaacccttctcaccatctgccttgccttggtcatgtttgactctgccttcaactgcagatggtgagcccaaggcaggcaagaccatcttgctagaagtggggggtgctgaggaggaaggtctcgggtgtggggaagggtcctggtagtgaaaaccatgcagggcctgcagggggcactcaactggagatgcagaatcaagtcgccgagcttggaagtcaggtgactgggagggaacttagttaaaatgaaagtctatggggaagctggcctttcttctaacactcctgtttgcttttttttttttttttttttgacacggagtctcactctgtcgcccaggctggagtgcagtggcgtgatctcggctcactgcaacctctgcctcttgggttcaagcgattctcctacctcagcctcctgagtagctgggactacaggcgcgtgccaccacgcccggctaattttttgtatttttagtagagacgaggtttcaccatgttagccaggatggtctcaatctttggatctcatgatccgcctgtctcagcctcccaaagtgctgggattacaggtgtgagccactacgcccagccggaagtttgctttttattgagagctcaagagaaagggcagaaatgttttcatgatcaatgtgaaagtgttacttagaacaggggttggcaagctacagcccgcgggccaaatctggcctgctgcctgcttctaagataaaagtctttctagagcacagccgtgcccttttgtgtctgtgttgtgtacggctgcctttgtattacatcagagctgagtcgttgtgacagaagccatatagcctgcaaagcctcaacgagtgtctctccatccttttcagaaaacatgtgtccacccccgatttagaatagcctctgggctctggatatctgcccacacctgggcagaagaccatccactcacagtgaacaatttgagacaattcagatgtaaacacactgttcagagccagtgttgcagcccggccggcagggtgtttgtgatggagatcccatggctgagggccatgcagaacaagctcgtgagaactgctactccctcgccagcatgctggaaagattcctgcttcaggtttggggcttcccaatcaatatatttttgagacagggtcttgctctgtcactcaggctggagtgccgtggtgcgtgtcggctcactgcaacctcctcctccaggttcaagcgattctcctgcctcagcctcccgagtagctgcgattacaggtgcacgccaccatgcccagcaaattttttgtatgtttagtagagacagggtttcaccatgttggccaggctggtcttgaactcctggacttaagtgatcttcctgcctcagcctcccaaagtgctgggattacaggcattagccactgcattcaaccctagtacatttttttttttttttttgagacagggtctcactctgtcacccaggctggagtgcagtggcgtgatgtcggctcactgcaacttccacctcctgggttcaagccattcccctgcctcagcctaccgagtagctgggattacaggcacccaccaccatgcccagctaatttttttttttttttttgagacagagtcttgctctgtagcccaggctggagtgcaatggcatgtgtacggctgcctttgtattacatcagagctgagtcgttgcgatagaagcctcctgcctcagcctcccaaagtgctgggattacaggcgtgagccactgcattcaaccctaatacttttttttttttttttgagacagggtctcactctgtcacccaggctggagtgcagtggcgtgatgttggctcactgcaacctctgcctactgggttcaagtgattgtccctgcctcagcctcccaagtagctgggattacaggcacccaccaccatgcccagctaatttttatatttttagtaaagacagggttttgccatgttggccaggctggtctcgaaatcctgacctcaggtgatccgcccgcctcgccttcccaaaatactgggattacaggcgtgggccaccacgcccggccaattttttgtatttttagtagagacggggttttgccatgttggccaggctagtctagaactcctggactcaagcaatcctcctgccttggcctcccaaagtgctgggattacaggtgtgagccaccatgcccagcctggccctaatacattttcaagtgagagacagatggagaaagagagagaatctgtaggtgcatttaaaaaaaaaaaaaaaaaagacacaagttctgattctgggagacaggaaatgtgcgccacccgccttgtcaaccccactgaaagtagctgtaatacattcataaaacacacagggcagctattcgaggactcagaaagttacccagtagtaggcaagttgggggaaaagactagaatccaaaataccaccaaaccagtatctcctggcctggccttaaggcaacctgaaggctgaaagtgggaagcagatgggagaagagcgagctaggaggggagatacctctgtggggtttttcttttctctgttttctcacactcctgcctccaggcagtcctgcggtgactgtggtggcactgctgtgtcaaaggggcctgcaggtgcctgaaacactgaaagaggggacccttctccagtcccaagagaacagggcaaagccctgtcaatccttcctttctctgtcctcccaccacttgaccctggtcatgggtgcagtcccaggaagtgagtggcagagcaggataaataacctcagttttctggccaaaataccaaaaagaggagcaccagggaactaggagttatcaggagatgacagagaggggagctcagggaagtaactaaacacagtgtttgatgagatcaaaggctcacccccaagctgtgcacgtgtgggcctgaccctaaacggcatttcagagacactgagacatgaactgtggccagctcactgccaagtccccaggtgcccctgggtgatgtgcacatagcacagagctgcatggtcggtcactgcacggcactgcaaagttgctgaacacaggactgacatggaaaccacactctgagaagcctggctggaacatgcaacctgaacccaactgaatcagtcatctgctaagacaaaaataatgacatttgccataggatttaaacaagacccagagcctcataacaatatttaaaatgtccaggatacaaaattacttagcgcagggagaaccaggaacatctctactcacatgagagcagatacagatgtcaccaccacgtaactcagatactggaattagcggatgaaaactcgaaagcggctattacaagaaacttccaactggtaaaaacacagaaagatacagtctcagcaaagacacagaaggcagaaagaaccgatgcgataaaaaactcacaggacaagctcaatagtggaataaaaaaacaagggaagattcagtgaccctgacaatagttcaatacaaattatcacatgtgactgatagagagtaaaaacaataggggccaggcatggtggctcacgcctgtaatctcagcactttgggaggccaaggcgggaggattacttgaagtcaggaattccagtccagcctggccaacatggtgaaaccctgactctattaaaaatacaaaaattgggccgggcgcggtggctcatgctagtaatcccggcactttggaaggtcgaggcgggtggatcatgaggtcaggagattgagaccatcctggctaacacagtgaaacctcgtctctactaaaaaatacaaaaaattagccgggtgtggtggcacgtgcctgtaatcccagctactcgggaggatgaggcaggagaatagcttgaacctgggaagcggaggttgcagtgagctgagatcgcaccactgcactccagcctgggtgacagagcaagactccatctcaaaaaaaaaaaaaaattaggcacggtggtgtatgcctgtaactccagctaatggggaggctgaggcatgtgaattgcttgaacttgggaggcagaggttgcagtgagccgagatcatgccactgcactctggcctgggcaacagagtgagattaggtctcaaaaaaaaaaaaaaaaaaaaaaaaaagaaagaaagaaaaaatgataagaaaaaaaaagactggagcctcagggacctgtgggacaacagcaaaagggtgaatgctttgtgttattggagttgcagaaggagaggagagagagtagggtgcaggaagttacgtgaagaaataaaggctaaaaactttgcaagtttggaggaaaatacaaacctataaattcaggagctcagcaaacaccaaaaagaataagcccaaagaaattcatcccagacatgtcataattatactagtgaaacctaaaaataggccgggcacggtagctcacacctgtaatcccagcactttgggaggccaaggcgggtggatcacccgaggtcaggagttcaagatcagcctggccaacaagggggaaaccctatctctactaaaaatacaaaaataagccaggcatggtgacgcatgcctgtaatcccagctactcaggaggctgaggcaggagaatcgctcaaacctgggaggtggaggttgcagtgagccgagattatgccgctgcactcctacctgggcgacagaatgagactccgcctcaaaaaaaaaaaaaaagaaaagaaaaggaaaaaagaaaactaaaaacaaagaaaaaatcttgaaagtagtcagagaaaaaaatgatgcattatttataaaagaatttgaatgactgtggatttttcatagaaaccacagtggtcagaagtaagtggaggctgggtgtggcggctcatgcctgtaatctcaacacattgggaggccaaggcaggaggactgcttgagaccagaagttggagaccagcctgagaaatagagggagatccagtctacaaaaaattagctgggcatggtggcacacacctgcagttccagctactggggaggttgaggcgagaggatctcttgagcccagaaggtcaaggttgcagtgagcagtgatcgccactgcactccagcctgggcaacagagcaagactctgcctcaaaaaaaaaaaaaaaaaaaaaaaaagtaaacagagtgctagctttggcaagcgcatatactaaaattagaacaatacagagaatattagcatggccccttaaaaattacaaaaaaagaaaaaactgtaagtgaaacatttgtaaaatgctgaaagaaaaaaactgttaacctaggattctaaattcagaaaaaaatataggagcctaggagtttgataaccagcctgggcaacatagtgaaactctatctctacaaaaagtacaaaaattagctgggtgtggtgatgcatgcctgtagtcccagctactcaggaggctgagacaggaggatcacttgagcctgggaagttgaggctaagtgagctgtgatcatgccactggggtccagcctcggtgacagagcaagaccctgtctcaaacgtatatatacacatacatacatatatacataaaataaaataaaaagagaaaagtaatgacatgacccaatagggttcctgtgaggacacatgaatcggtgtgcaaagccctcctgtggcacccatcagtgcccagtagacaggtgctatgctgctgtcctcctgagccctcccctgccctctccaccctccttgtgccccaggaggccggcctcagtggactgctcacctggactcctgccctttgacttcactgggtctggcaggagatcaaaggataggaggcgagagtctggggtacccctaattctgcctcctgccgatgccagtccctggcgcctcaccatcacttgtcggttgccttaccctcccatgcttctgcgattgtcctgtcattaaatgctttcctgtgacccctctggatgggccagctatttcctacgggaaccctgaccgatacaacgaattccacactgttccttttcctttgacaaaagcaaaatccatgtctgtagactgaccttcacggagttcccgtttgcctgccttaccttctcttatgcctctggtcatctctggtcttggagatgaacacacgcccttcaccctcccctttatcttggcactgaaacccctagctcactggagtcttacctgcttgatgcaatcctcttcagccaggcgttcctgaatcagctggacgagcagcgcgctgggaactgtctgaaggaaaaaggacacacagaatgatggcccaaacctgcttcctgcagctcaggacacagaccagcacacacccttcaccaacgccctggcctctggaaagcaccgaccaccatcgggccccgcccttcctccacccgctgcaccctttccttgaactctcttctccccccagcatctttgagggcctccctcacacatgtactcaccttatcctgtgcccaagccccaacatgccctcgcccacctccacctgaataactccagggctccctcagagcctcagccccaagtgccagcctgcaggaagccctgccggatcctcccaggccaggctggtgctacttcccgtgctccatcatcctggatggagaactctgtcactgcactaaccaccgcacacgctaatggactgcccacgtggctgtgtccccaggaagttgtaaagctcttcaaggaaagggacagtgtcctactgactctggactccagacagtggcgggtgggaggggattggctccaagactcagcagaggcgagtgtgtccatctcttcccaagtccacagtcagtgacctcatgttggtaacaaaattggccacggtgggagtgtctacaccacagaaatgataaaggctacaataaggactccccaccctgcccccagtgctggttgttgaatattgaccagcagaccaaatggtatcaaggatataggaagccctgtcgaccataatgaaacttcaaattccttgatgcattcaacaagcagcaatcatgacggctagcatttgttgagcacgtgctatgtgccaggcactgggccaagcattccattctttgctttttgtaacaactctgtgccatctacactccacttacagtaacacgggcccccaaagaggaatcccaaagaggagtcgccctcttgcccccttctgcctgtatggtctgggtgtgctcaactctatcctcagatccagaggagggccctgactggtctaagccaatccgcataccccactcctgaccactgtgattgattcagagtgttggcccttttcatagaggaggaagctgagcctgggagaggtgaagctgcttccccagggtactccgcactctcccttctctgcaaaggactggggaggaagcaactcttctcaggggagtcgctgaggcctggcctgtgcctttccttgtagtgcacaacaggggctaaaaatctcctctacacccacccacatttctgaaaaaggacatgggaagtagaaatacattccaatcagaaagttccttgctgggggcgggggcctcctggcacagcctttcttatgcagagcagagactcggacttggcatcagggctcacctcccacctctgcccagggcaggctctctgctcctggcggctgcgatacagccagctgggcgaccctgggcaaagccttgacctctttaggcctcacacacctaaccagtagaaatcagtaatgagactgcaaatgtggcttttattttaattttccatacactccacttacagtaacatgggctcccaaagttcctttgaggagtcaccctcctgcccttctgcctgtatggtctgggtgcgctcaagtccatcctcagatccagaggagggccctgacttgtccaagccaatctgcacaccccactcccagccactgtgattgattcagaggctgcctgggacccagtcccagctagtgaaagtcaggcccaggacatcagtgcaatcattaggggcatgaacccctgctttccaccagctcagaagctgagaaaatgtaagagcgggagctgcggcagccacttcgtgggcatgacgggtgtggaacggaatgaaaccagcacaaagggaaagagagaaaccagacccagctgcagaatggcttttccagggatggggaatgggaagaaaaaggggagatagcgagagaacgagggagggggcacctctgctgggaactggatgaatatgttcactttaaagttatggggtcaccatgtttctacgaggtagacagccaaagtcaagatcgagagcaagagggagagacagaatgaatgaatgaatggatggtgcacagaggaaaaaggagaccagagaggcaagaaggaggcgagccagcatccagtccctggctccaacatctgctgagatagccctgtatccttatcctaccgcccccttcccccacctttcttccctaagccagtggttctcaatttgattgtgcaacagaatgctggcagagcttctggaaacacaaactgctgggccccagcctgggagctctgattcagtagctctgggacagagctgagaatgtgcatttctagcaagttttcaagggacgcggacgctgctggtcagggcatcacacctggagaaccactggcataagcccacctacacagggcccccggggtctgggggaagctgctagagagggagggtgtctttccgccagtgcccgtttccctcaggtctccaggggagcttccccaggctggcaagggaaggggtggacaggaagcagccctgtcccttccctctgcatcccccctccgtctcatcctctcccctcccatcccctttcatcctttcccagcccctcaggtcctctcctgaccccaggcacagccaatttccattctggggctgtttttcccagattcctctgccctccctgacaacacccattcaggaggcagtgttcaaacaggtacaggatgcagagaagggtgccaaccaggacgcagggggtgccagccagtcaaagagcaccggctgaaaggcggacagccccggtggggcacagcaccccctgcagcctgcacagcaggggacaggcctgcggctttgagcgcagctactcctgagcgccccccgctgctccccgccactgtgctgtctccacgccagctttgatgtgtcacgtcagcagcagggctttcagaggccgcttctagaagccctgccaaactgtcttagcaggaatcagcctccctccttgcagagcactgtgatgctctcccaccccagcccccaaagtctggcatttggggagaatcagggagaagctgacagtgcagtgaggccgctcctggccacagagaaggctcagccccgactcaggcccctggccccgggtctccctgctcggtggcaccgcagcacccagttgctcccgtgctgcttccgtgcacttaagggcaggacaggctgtgtttgctgcaatttggatttttctctcttcccctccagcacccagtgcggctttggtgggtttcccggcctgggggcagactcgctgatctcctagccctccaaggtgccgcccgctgttttgctgttctgaggcagccaagtgtgcaggtgccaaccctggctctgcccctggggcgtcacttgacttctccccagtgggctttctcacactgggatggcatgagcctgcatcttcctgtcccatctccaggccccactctcagggatcctaatgtccctgtgtcaacatggtgagtgatgcctgctcagaagttgtgggcattttgagctacagtgtgatcttgggaagtagagcagggaggggaacaggtgagatgccctgatctgacccccacaccccccttctccataaaggggctcctcctggtagacgagggaaacccagtagtcggacttgagctcccctcagaactgacagaacatcctttagagacaactcccattccaaagttactgctgctcggagctgtcagagcaggttaggagacagcaggaactgcctcctagagtttgggagggggagacaggagggttgggggaccagagacaagaggagggaggagagaggagaagaggcttcaaaggaagagagcagacctcatagcgtggcacccagacaggcgcacggaaggacgtggcagcaagagaaaccctggactggatgaaggccaggaaattttcacaggagtgacggagcctggtgctccagtttccctgggtagagcagtcacctcctctaccccaagccttccaaaaaggcctgctcgacgccactgcctggagctgttgactcaggaaagggagggagagactgagggcattcccactgtgtctcagttcagcctcaagaaatgggagcagcaaggccagctggagatggagtggccagaagtgagggagacaccaggcaggactgggaagcaacatctgtgggctgtttcctagaaatcctcagaactacttggaggggactatgtttcttgtgtgcagacagaggtaggatgagggctcacgttgttttttttctttgagacagggtctcactctgtcatccaggctggagtgcagtggaaccatcatggctcactgcagcctccacctcccaggctcagcctcccaggcagcagggactacaggcgccccccaccatgcccagctaatatttttttcttttttgtagagacagagaaaaaaaagaaaggtggcgatcctcccgcctcagcctcccaaagtgctgggattacaggtgtaagccactgcacccagccagatttttttttttaaacagtagaaattgaaggctcataagtacaggatcagcacctgagagtggctcctcagtggccttccccctctcccccttctcctcccttctcctcccctaccctgtccccctccttccccgtctcctccccctcctcgacccgggtcttcctcacctgagcctttttgtggtgtttatgatgttgagtcagactgtgggcttagagacagggccagagaaagcagatgaaggaaaaaagactcggctgaaaagatgaattcaattaacttaataaatgggaagaacgggaggcaaaggtggcctcgggctggggttccaggggcagcgtttcaggggaacgggcctgtggagaaggtgttagggccactactgtgggaagaaaaggtgggggtttctgcagtattactggaaaccatgtccctttcacggtgttcggcgagaggactggggccattttgacattcatttcgatggctctgaccatgtccttgggtccctgatcccctccaggaaaagctgtggggtcagcatctagacaaaatcactcaggggagccagtcgccagccaatgaccttggctggtgtccagggacagccagcgtcttcagggcatcaaacgtctcttccagcccggcctggacccagaagcatcacatgtccctgatggtccagtgagggaggggcctgagcaggagagggcccaggagccataagaacaccatctcctcggcgagatttataactctggctggcctggtggaatcctcagtgacacttctaggtgtgataatgtgtctctatgcgtttactgaaaaagggcccttatctttgggttgcggaaataaatgaagacctcccaaatgagacaagccaaggctgtttactcagagcttgctgggcaagggagtcagccagcatcgttcacatctggcggactcgaacgcaggtagaggacagggagagttctagaggaaaagggaaggctccaggcatgcctgaaggaggctgctgctggggagctggaggtgtctctctagaggtgggcattctacaggactagacaggggagcatgtttggctttctctggctggtctcaggttggaagcaggaacaaaaactagagacactgccagttattaatcatgccctggccatttgggataggtggctatagggatgacttagttcagcttcctggactattggaagagagagcagcctggcttcctgcaagcctggcacagcaggtggcttcccgggtgggctcttgcaggtcatgggttggtctcctgggtgggctgctgcagattgtggggcagagtcttatgtttacaggaggtcttgccattgtccacactgaatattcaatctcagtagatctggactaaaacacccatggggaaggtcaaatgctgtctgggtttgctttaaaataacccagggcagggggagcaggtgagggtgcaacccaaggctagactgccatgagctgacatctgtcgaagcaggggatggatccatgggggttctcagactatcctcactgcttctagatatttttatgagatttcacaacaaacacttaaaaacaaacaaaaatccctggccactgtgaacccccagcatcctggggcaccatccccgtgggctttgtgacactgcccgattccagaccgttccatgccttagaacattacagtgtgccctttgggaaggctttgcttagtgtaactgtggttatggctccagggggtccctaaatcttgcagcctgtacccccttcccagcccagagccagtgcctaggacttagtaggtgctcaggactaacgtaaatgaattagtaaatgaattgagtcaaacaagccaccgattaattgctttattgaaggttccctggctcccataccctggcttgtgcttagttttatgggaccatcagtctcctcactggctggaagcttctggggtaaggagaagaaactcatctttgactctcccacagcactgcagaatagtgcttggcaaaaaggcagttaggaagtatttcagaaaccactgggaaatgcctaagatggagatgtcttggttaacagtggcaacgtaagagaattctgcttaggagggcaaagctaagactagcaggagaaaatcaggtatttgaaggtatcattactacttgcaaaaagagccataaagattccaaatcagcagacaatttaaagaggacatttaatgagaggccttgactggcaggcactgtctgcagacaaggccacgcatggccgagcctgccatgtgcccactcgctcttcagaacattttactctttgatgaggcctgacatccaggcctttcatcttccctccaccagagtttctgagccaaggaccccaacaagacacccttgaaagcacttcaatgtggtttgaaatatgttgataattagcaaaatgaaacccaggaggaatttccttaaactccctcctctctgttgaattttataaagctaataaaaacatttttatcctacaaaaaagccttccccaagaaagcttatcttctgcagaaaatgagataaccactttctttctaaaaccatattcccagcccgaaaggctggtgtccccgcaagctgaagccacacagtccaactcctgcaagactgcaggggcggctgggggactgacttgccgtgggggtggccgccttgctgagccaggctttccttctctatcaagctgctgtcataggcagacttggggctgggggtctgtcgaagtcacacccctttctctctctttttttttttttgttaacacagagtcttattctgtcgctcaagctggagtgcagtggtgtgatcttgactcactgcaacctcagcctcctgggtttgagcaattctcctgcctcagtctcctgggtagctgggaatataggcacccaccaccatgcgcacctaatttttttgtattttggtagaaatagggtttcaccatgttggccaggctggtctcgaactcctgacttcaagtgatctgcccaccttggcctcccaaagggctgggatcataggcgtgagtcattgcacccagcccatccatacctctcatctgtgagaactgccatcccccaccaaccaggagtcttcatagccacatctgagctctgtggcctcactgagccctcactgcacacccctcaacagagctgactgtgcctgacacgtgactagctagcccgggcagatcccccttcctgaggatttggctttgaagctgcctttgtgggtggtctgaaccgagaacacaggagacaagaatggagtggtggtcacgagtggctgggagcatggcaagaaagacagaagagaggaggaagagtccctgcctcagcctcccaagttgcagggactacaggcacgtgccaccatgcccagccagaaggaattttgaagaaatattttgagtttctatttgtattaaagagaaataatgtgatcaagccttatatttccctttagaagatgtttttcaaatatcgagctgttggtcttttagaaacaacacccacacctcctgcaatgctccccagcgtgtgtgggagggacagggggaatgggcactgcccggaccagagggtgggctgtgcagcagggtgcccaaggctatgggagggagacgcctctaaggtacagaacatgggggctttccactctggggacagctggacagctgccctttcaactgctggcgcagcccaaccctgcatctcctggcgcgggccgccaggttcagcacttgcctccatgcctttactcggctgagcctaagaagaaaaagagcaagcctggaccatcccaccaagggcttggacaaaacagcctccttcactcgacccgtgatcctttcccactgcaaaaactcacctcggtacccaacaggacgtgagcccagtaaagaattatcttcttccttccttcacaccctgcctgtatctcattttaccccagcattttcttgtactcaatcaaaaatgaaatgggaacaaaccaagcaatggtcaggtggcagtgggtgtggcagtgggcactgctgctgtgtgcctacccctgtccccggggccagtcctaccttcctttgcagataaagccttctggcttcggtggccgtataggaaaactcatttaagatcaggttctccagggtgaggagactgctgttcagatgtttgcagagccacattgcctgaagaaaggaaagaagaaaagggcattttcataaaaacaataaatacacaaatgactctattaaaatgccctggtccttccctctcctatgggaaaaggttggccatggggaagcacaattatttccagctggaggacggccaccaagggagacccacccataaagcacctgctggcctaagagccctgctcatagcatctcttcttctaccagcatagacttaaatgaagtgggaagacctacaggcaggttacattttagctgcccttggcgtgctttccaagctctgtggaccatgagtttcatctcaaggaagactcagaacaggaactttgaggacagaacctaaggatgggtaacagcccacactcagtgttcttttttttttcttaaagattgggagctggcatgtgctggccaatgggatgtttagttcattgataattactctatagtctataagggaagagtaaattttaagggagaataatggactaaaacattcttgacaccaaaattgtgctgatgactatttcagcctcgagatggttctgaaggcccttccagggcctggggctggtgtgaaccttcgttcttcctgttccttcattcatcccctgccaaccaggagtcttcatggccacatctgagctctgtggcctcactgagccctcactgcacacccctcaacagagctgactgtgcctgggacacctgaccagctagcccaggcagatccccttttctgaggatttggctttgaagctgcctttgtgggtggtgagaaacctcaatgacagcattgggaagaagccctttttgactgtacatcatatcatcagatctgtgtgtctccaaagggcactcaggagtggggacagcaattcaccaaaaggcttgttgctgaaacaccagctgccagggcctgacctcgacagagaggacaaactcgatcgcttcagccatgctgggacttgccgaaagcaggtctctgcgttctgaatctgctctgcccagcagattcctaccagtgaccagagaagagctaggacaggacgaagcacagatggccccagaattcaaatgtcaaagacaaaaggagagcctcccactgagcaaccagactcctccagaaaaacgagttcaacgagcttgtctgtctaaatgcaggatctgtcatcctcattcccaatgtcagaattacctggggagtgtgttctaactactagttttttggggctctgctccaggagattctgatgaggttggtctgcaggggactccaggaacctgcatttttcatagcaccctggaaatgctaatgatcagcaggtctgggagtccctggcttctaattgtgaaacagcaaaatggttggactcaggtgggtcctgcagaaaggcttagaaccctacggcctgatatggaggaatctaatagaaaaactatagactgacagaagggtgagcagatggacagatgagtagaacagctatgctaactccaaaagtatagcagatgcaggttagtttgtgcaaggatcagtcattttaactccttttcagaagaaagcaaggtgccagttaaaccggggaacagcctgccccatcccgtccatgatacatgctcacagcaatgatgtggtcacagaggaagggttcgctgatgttcaccaatcaggcttttaaaaggtaaaaaaggtcccatcttggatgaatgaaattttaacacatttttggcacttaaaaatggaccttaggccgggcacggtggctcacgcctgtaatcccagcactttgggaggccgaggatcatgaggtcaagagatcaagaccatcctggccaacatggtgaaaccccgtttctactaaaaatacaaaaattagctgggcatggtggcgtacgcctgtagtcccagcttctcgggaggctgaggcagaagaattgcttgaacccaggaggcggaggtcgcagtgagccgagatcgcaccactgcactccaacctagcaacagagggagactctgtctcaaaaaataaaaataaaaataaaaaataaaaaataaaggtaaaaagggttccatctcagatgaatgaaattttaacacatttttggtacttaaaaatggaccttaggctgggcgtggtggctcacgtctgtaatcccagctctttgggaggctgaggtaggcggatcacctgaggtcaggagtccaataccagcctggacgacatggtgaagccccatctctactaaaaatacataaattagccgcgcatggtggtgcatgcctgtagtcccagctactcgggaggctgaggcatgagaatcgcttgaacctaggaggcagaggttgcagtgagcccagatcgcaccactgcattccagcctgtgtgacacagtgatactctgtctgaaaaaacaaaaaaggaccttaaagatcgaagccacagataaatgaagcacacaccaccagtttctggacattcactgtccagaaaagggcattcactgtccagaaactggtgatgtgtgaaaaagtgtgggcgaggtgggcccaggcatttgctgtatcttcaaagatgtattttctttaaaatgaggagagaacaaacaaagcaaatatggcaagatgttaaatttgcataaaatctgggagttggatacgtgaatatcgatggtacagtttgctgtgcttttctgattcttttaagtatttcacaattaaaatgctcagagtaaatattaagattccaagtcaaagtctatgaaatgcgtgtactgttggacccagcacgtgtacttctggaaacgtaccctaaggatatagcgaagggtgagcaaggagagcgtgtatgcaggccagaaaaagcccaggaaggtgtctccgagcatgctaaaggaatgctcatctctggatggtcagggaattctatttttggtcttttgtagtttctaggttttctgctatgaatacacactaccttttgtaataagaaggaggagaaggaaaagaagaaaagctcagttatgctacaaattcacggaggtgcagtctcattccagctctggaggatcaatgagatattacagcatcacaacacttaatatgatacacttactattgttgttttccctgaggcgggtggacctaatattacaatcctgggcactgtggaataaaaagatttgaatgtcaccactcaacatgacaagcagcctcccacacctgcggtactcggggtgtacttatttctccctccctagatttcattttctgccagtgacacggccatttgtaacccagcagctcagagacactcttgccatggaacgcattctctgtgttcagagaggtaagtgatcaccgagatggtttattcttctgcctccaaggggacagagacacggtaacttgtttaccaaactcataaatatcaagaacaattgggatttcaaacaccacaaagcattttaaacagggactttgtctcaggaacgctctctccaataaggctgtaatttatgcaaatcgaccttagaagcttttctttatgtttatgccgttttatttagcaaattgtattccccatgattttacagagggaagtaatgggaaaagcctggagtgtatgggccagatttataaaacccaagaaaggaaagtctgttttcaaagatgggcatttctatgcaaatggaaaacactggcaccttgtttgattttagtcctggctggttttggtcccacagaattcccaacccaggctactgacaagagtgtgatatgaaccacaggctcctgaacctgtgaccgagagtctgggctcacccggcaggtgaagctctggtggcaggcccaggccctggccatcgtggaagctgggaaggcattttcagcttctggggtgggagccagggcagagattcagtggccctttctctgttctaggcctgtaacctggggcaaggcctcccagggccctccctgtggggagagaacccactgcaggtggaaaaactgcttgcaggacaactctggaaacaaggtggctttggggacaagtggtcaggtgagaggaagaggtgagacagagctagagtggctgctggcgatgggaaaagagctgaccagcatggtgagaagggtgcaggaaggcatcacactgggttgaaatgaagggaacagcagtggggtctggacagatgcatccacactgcctgcctgctcaacaccatcttgattgggccagctgtccctctccttgtgggaagccggtaaccttggcctggcccctgacccaaggtgacagatgaacagatgtccactgcaactcacatgagcctctaacgtctgcatgagagcctattctggctgggctttcaggagggaatctcatctcagcagaggagagaggtgctgtatcttctagtttggaggcagacagagaaaaggaactagacatcgtccttttggccagcaatgtaatggttagcacatctacacccagctggctgcttgggtttaaatagatctttgcccaaaatcatggcaccttctcatttttggaggaagtcaaggtaactcactgaatgatcctctcctttaacctcagaagctgtggaccttcatattctccttatggctgttccctccacgttcctgccttgccacctgtcatttcccatcaggaatgtcctcccttcccagcacccagcacccccagcctcccactccttctccctccccgagatccttgttctcactccctgtggaggcccgtgatcaagtgatgggctgccacagtcttccacgttggtgaatgtcagcccactactgagaaacaggtggagttgctgtccccacaggaagagaagctcccaagggcagagaccgagtcttatcctcctggatcacccccatggcggccagaactgtgaggagccacacacagtgaccttcagggccacctccttggccatccccatctcgtcctatggtcactgtttgtcacctttgtcaccaccattactactgccttacagagggccccctctgccagtcagcatgtttgggtacaagtgcagaaactgaatgcagctgagtcaagaagaaaagggggttgattgctcacacctgtaatcccagcactttgggaggccgagatgggcggatcacttgaggtcaggagttcgagaccagcctggccaacatggtgaaaccccatctctactgaaaatacaaaaaattagacaggcgtggtggcacacaactgtaatcccagctactcgggaggctgacacaggagaatcacttgaacctgggaggtggaggttgcagtgagctgagactgcgccactgcactctagcctgggcaacagagcaagacttcgtctcaaaatatctatatctatatctatgtctatttatctatctatctatctatcccagcgtggctcataagagtcctgcacaggctggggagccaggccttcagggctaccccacaggaacaacaccccaagcaaggccaccaaatgggctggggagacaccagacagtgctgcccgtgcccatgatgctgctgtcacatgtgggcatggtgccgccatcaaccatgctgccgccatcaaccatgctgcccttccacccaggaagcaggccctgcggagctgccaggaagtgctccaggtcctgcctgtgactccgactctggactcgcctggcaggggaagcgctggtggtgggcccagccctgactgtcatggaagctaggaaggtgttttcagcttctggggtgggagccagggcgggcattcagcggccctttctctgttctaggcctgtggcctggggcaaggcctcccagggccctccccatgggtgagagaagccaccataggatatagtgtggaaaacactgcttgcaggacaagtatggaaaccaggtggcattgaggacacatggtcaggtgagaggacgaggtgagatgggagccagagtgccatgggaggtttgtggggaggagtggcagggagggtggtcaagggtggaggagccttgggccacgaggcagagggctcgtgtggatcatggagagagcgcctgcttggccaaagtctgatgagggagcagtggggaacctgggtccactcatgcaccatcgcctgctgcctctccagggctctgaccacaggccctgctgaagctcctccaaacacagatgaggcccaacagggctcagggcgcccagagcccaaggaaaggggagatgcagctcggcaagggcctttggggagcgaacctgactccacgcattcatctgagagttcccgggctgggggctgcaggggaaaccctccccttccaggttcctgtaagtggcacccaaatggtacatgtctatgaatagactttaaaaggggaacatccacggcctttctccccacctaatttctcccacacatttatgtgattaatttcattttcttaaaatctaacaccttgaaactacagccctgctcatgagtaattatttataaacagtgtcataaaaggctgctggactgccaagagtaatcaacttcttccaaccacttcaaaggaaatcaaaaaacctttccatccacagatccttttgaggtttaactaggagcatgatttaaaattcacaagaaaacccttaggtattggagctctaatacacagctttcttggacaaacgtttgataaaaaacgaaacataccattatatacaccatcgcctgctttaatattgcccagggctactgtaaatgctcactttgtactaaatctgcctttctggcggcgaaggggctgccagcccaagtgccggggctccctctgctccctcgtgtgctcgctcaccgggatgagtccggggccttctttctctctacaccagtcaccagccatgtcactgtgtgtggcagttaaccccaggcccagtaagaggaagggttgaggtcctagctatagttaccccaggccgctgcatggctggaagggggcacaatgatctgacacaccagcccaggggaacaaaaacacacactggatgtcatgggcctctccaagcctcccgcactcttctaggacacatgaggattgggcttagctgattcgaggcttctcccactcctagaaaattcacctaggcggccgggtatggtggctcatgcctgtaatcccagcactttgggaggccgaggcgggtggatcatctgaggtcaggtgtttgagaccagcctggccaacatggtgaaaccccgtctctactaaaaatacaaaagttagctgggcatggtggcgggtgcctgtaatccaagctagtcaggaggctgaggcaggagaatcacttgaacctgggaggcggagcttgcagtgagctgagattgcgccattgcactccagcctaggcgacagagccagactccatctcaaaacaaaaagaaaaacaaaaaaacagaaaaagaaaagaaaagtcaccaagcagggtagtctcccctgtctcccttcctccttcccatttttgcttcacttgtccacagaggcgtgggcaaagagagagaaacccatgggtgtcgctctcttctttccatttcagtggttggggcttgagccaaaggacaaaatgttctaatatccataaaagctgccagctgagggcctgcggtggagtgcagggctgtgggaaacaaatgaactctccaaaacagtggttcctgggacccagtgactcgactccctgagagcatccgggcaaaaagctggactcagctattcaggaggacagacccccccggctggaggctggcccccagctagagacggcacgaggcaggtctggagcctaagcctctgctcgagaacaacagagcaggtgcagtgcagagaaaggagcaagggctccttggagggagcttcaggaaagccccagaccttcggatgaagggaaaggggcgctaaggagggtgggaggaggagacaaaggcagggaggtggcagcggaggtggctgtccagccaacatcaactgcactccatccaaaccagaaagatgatgtttaaactttaaaattctgatgaagtggatagtttgacattgaaaattaaagctgcacacagaggagcaagatcaaaacaaagagatgattgaatctgcctcaaatttcttgaaattcaaggttcttgagcttctaggctggggaactaggtaagccttgaagtagcggtttaagaacacagagggccaggcacagtggtccatgcctgtaatctcaatgctttgggaggccaaggcaagaggatcacttgagcctaggagcagggaccagcctgggcaacatagtgaaaccccatctctacaaaaaatttttaaaaattagccaggcgcagtagcatgcacctgtagtcccaactactcaggaggctgaggcaggaggatcacttgagcctaggaggtcaagcctgtaatgggctgtaatctccccactgcactccagcctgagcaacagagaccctgtctctaaaaagaaaaataagagggagaaaataaaaaaaagagaagaacacagggcatgcatgattttcaaactaacagtagaaaatgtcagtgcaacctaatttatgagagttcaagtggttacattattatcgagcacatttttttttagatagagtcttactatgttgcccaagctggaatgcagtgggtattcaagatgaagtcgtggcaccatggcctctcactcctggcctcaagcgatcctcctgtctcagcctcccaagtagctggagctacaggtgcaccaccacacccagctttcaagcacatttttttttttttgagatagggtcttactctgttgcccaggctggagtgcagtggtgcgatctcagctcactgcaacctccaccccctgggttcaagcgattctcctgcctcagcctcctgagtagcttggattacaggtgtgtgctgccaagcctggttaatttttgtatttttgttttgttttgttttagagacagagtctcgctctttcgcccaggctgcagtgcagtggcgtgatctctactcattgcaagctccgcctcctgggttcacaccattctcccgcctcagcctccccagtagctgggactacaggcgcccgccaccacgcccagctaattttttttttatttttagtagagatgggatttcaccatgttagccaggatgttctcgatctcctgacctcatgatccgcccacctcggcctcccaaagtgctgggattacaggcgtgagccaccgcacccagccaattttcgtatttttagtagagatggggttttgccatattggccaggctggcaagcacaatttttaatttagaaaaatctattaagctttttactagtggaaactagacgtcatattcctggaagctgctacccatgatgcatcagggatttcccattccttcagccactactgaccagaccagagtttcacagcttctatctgggttaaccaaacacatccatttcacaaacgaggaaagtgaggccaaagagagccacgatctctcacgtctctacattttaagatgagtgagctgcagggtccctgacagtggggagggaggtgggggggtggcaggacagaggactgtgctgcactgcactttccactcgctcttggttgacttttagtcttactttgtttttactttacttttactctacttttactttagcttttacttggctcttatttcacttttactttgtgtttccttttgctttgctttccctttgcggtccattctttctctggtggcggtgtgagatagctgcgtgtgggcagagatgctctccgcagccctggaataacagagttcagcagcactcaagctcccagcacccactcggcctcagggtgggggcaggggggaatgcaggaactacctccactggcaaatggagtcagtgaggcctgggggcgagcctaggtctgcagcagtaaggaccactcaggagcgcagggtaggcttaacatccaccctaagagcaggtgatgaatctggggagacaaaacctcccacctgtaccatgtaataaacagccaaccagagaaaggaggtctctaagagtcgctgcagggcagagtaaactgcaccaggaaggtgggtttggggagaaggcaaatcagacacggggaagggggtcccaaggccaccccagcaccgcaccacccccgcctgggcatataggacgctcagtcaacatccgctgaacaagggaatgtctagtgaatcagccatttgcacctaaccagaggctcagaaaagggcctttttgttggccctttgtggggtctctctctgtacctgcctgcctaggtccatgcaatggcatcgggacccaagattcccttactctgctgctccgcagccaggcctggatgcgtcaggacttgcatgtggggcacaaggaaaaggcttggaacctcctttcttttttttaactacctagtgtcatttctcaccttgggccttctgaacctccacacagggcatctctgggctctgtcctcagctgtaccaagcactaatttcactggtgcactggtagctccttcaaagcagctaatgctccaacgaaagaaacataaaagctccaagacatcggtcctccccaacagctcacaaaggacaggactgatcctccacttggcaaatggaccatggagtggagtgaggggccttccttgagtgagcgcctccctcctccccagttctgtgctccggccttgggtcaggctgacctgcaccggccaactgcaaaggtttggggagctcggaaactcattaacaggctccgataatgagaccgtcggaaaagcccaagagcttgcctgtctaggtagaccagaaaccaaacttacacctgacaagtggagtgatcagagagctgaaacccaacaggcgacatcagctagggcaggcgaaagcattaataattgattccatgggtcattctggggttttcattttaataacttggcaagagaatttttataagttgtgctccaaaagaaatcaaggcatttttcaatgaaccaccacctcaagttgatgaaacccctcccttctgacctcccttcagacacaggtaggacagaatggtgctcagctattctcgggatggggcagggttcctggagaggaagaggaggaggaggcagaggagtcagggaagaaggggaaggaggaggaggggaagggaagacgaggaggggaagagccccagccagtgctcaccattgtcgttgtctctatgcaagtgctggatcatgaaggggatgggatcttcgggctggtggatcaggagttgctccagcatgttctgtgggtgcagggcagacacccaggtggttaatacctgcaagggcacctggtcaccacagataccagctatggggcctgctctctccactgcaccccaccaaacatgccttcaacctgggacccagccaccgccccagctggcatctgcttgggtccccatgagcagaggcatgaggggggccacgtggtgctgctgcggaggcacctatggggaggcagaagtggaggagtctcgcccctgattcagagcaggcagtccagggctctctcccctggggccctttgagcttcccagaccagccttctccaagttctcaagcatcaccattcccctcagagccttagcagatgctgttccctcagcttggaagcttctgccttgtcctcatcctggctaacttctgctcagtctcagatctcaatgggaacataccttcctgagtatgtgcactacgtaaatatgtcagatgctcctgcacctgcctgcgggcatcgccctgttccacgcctcaccctgtccctactcaccaggccaccatccccccggcaggccatgggttctgtgggcctccttgtctgcctagagcccttggcaccccaatacctggcagtcatagcagatgcccagcgcagatgtttgctggggaacatgaccgtcaccactaactgtgtctctccagaatggaacagaatgttaccagccagatttctaaatagtcctgggatattctggccatttcatccaatcaggcaagcatatcaagagaaagcagcttctggggttgcagaaccctaggcagagaaatgaggaggagctcatagcagctgtgctgctgcaataaggggtatccttgagccccagggacaaggagggaggggctgtagccctcttggagtgaagggagtgtggggcagggaaagagcaccgagccatgagaagtcttggttccagccccactgtatctcatcagcaagtcccttcccttctctgggcctcagcttctctgcctgttcagtagcacagctggagtgaattcatgtttgtatgtcactggtgcgatgatggaatgagatgattttagatggttcacacataaatattttacatttcatgtttaaatcattgtgtatttaacgtgtattagaaatataagtacatcaaatcaataatttcaaggatatcacttaggatgaggcaaaagcggctatttaattttttaaaaggtgagttgatttaaacaagtgattagtttaaatggaggtgcagtagcggttatgcaaatctgtacatgtgatacaactgcacagaactgtatgcacaacaaaaacatcaatgcaggtaaaaatggaggaaatccaaacaaggcctacagttcaggtaatcctattgtaccaatgccagtttcctggttttgacaatgtgctacagttatgttagatgttatcacgggggcaatgtgggaggggagaccagaaatccatactattttttaacttcctgtgaatctaacattattttaaaatcaaaagtataaaaaatggaaatggtcaaaaacatggagggaatccacagatgactaaggactggaaatactggactgaaagctttcttgttgggaggccgaggcagaaggactgtttgagcccaggagttcaagaccagtccgggcaacatagcaagacctcgtctgtactaaaattaaaaaaaaaacattagccaggtatggtggcctgcacctgtagtctcggctactctggagggactaaggcagaaggattgcttgagcccaggagttcaaggctgcagtaagccatgattgtatcactgcactccagcctgggcagcagtgcaagaccctgtttcaaaatcaataaaagctttcctgggcaattcctccaacaatcaatgtggaaaacacaccaggttctctagagcagacaacagggctccagatgatcccccatcctgccctgacctgctgacttctaacccagctagctatttgatttgtgattggccactcaagcagttttaggaatctcttgctctccctctatcagttaacactttccgagggaaatgtgtttgatggaggtgcagacacgggtttcttcgtctgggctcagctgtctagtgtgcagggcagaacctcaaatgaccacagacaccactatgccctccatgccatgcccctggggatggggtgtaccctgggaagcagacaaatgatctgaaaactgagctccagcttccccttgcctctcagaacctttgagtggctgagagttcttcccctccagctcctgaaagccttgacctccaccacgtgcaaaagggaaaactggggccctggcggggacggggcctcgcccaaagtcacacggtgagctgggggcccagtcaggcctggagccagaatgagagcttcggagctgccggggacgtctggccctgaggaggagggaccaaggtgggagatgctgctgtcccagaggcggccctctctgaggatggagatgccagcttgaactcggacaatgcccacctcagaaacctgggccgagaggctccccacaaattcgacagatggtaattgtcagcgccgggagagcccctgggagaccacctcttgcaacctggcatttcacaggtggggaaaccgagaaaaggaaaggactggttccagaccataaggcccgctggcggcacagccaggaccaaatcccggctcgagtggcccccttcctccccctgggtccgcctgaggcaaacccgggcaggaccaggagcgtccccagctcgagggccccctcggggtcacggcgacacacgaatcgtacatcccgagttgggctgcttcgtgggcgcgcgactcggccccagctgcgggtcccggccgcgcacccgacgtcgcagtggaggctcccgagccgccgccagcgtcgcgacgggcaggggtgtccggtcacctgcatcaactcgaagatgtggttctcctccccgtactggggcatctcgggggggatacggtgcggggcgatagtggcgtccatgtagccgtctcggctcgccgctccctagtaaccgcgtcgctagggccgccgcgccgactgcgtcatcagcacgcgccgcggccccgccctgcaggctccgcgccgggcccagatacccgatcctcggtcgcgcgggtcgcccccgccccgacctccccggctgacgcgctctgcggctcgggcaagttctttccccaaccccggcctcgcttttcccatttgcgcatcttagcgggggacaccctcaggtggcttccagctgggcctcctcgtatctgagacccccgacgaaacccagaaggggcaagtcggccctccgaggggacgggaggcagaacctgcttctggttctgtcagtgctccccggcccggctccctgtgcctcagtttacccatctttaaaacagacgcgggaataaatgtgggggagggtgtttgaagggggaggggcgtccatgagatgggccggaggttcgaggatcgggtggaaatcctcagcccaactcctagagtcgagccccggtagacccctcccagctccccggctctggccaag

SEQ ID NO: 993 - DNA, 1745692 bp, Homo sapiens; identical to SEQ ID NO: 279

SEQ ID NO: 994 - DNA, 1776225 bp, Homo sapiens; identical to SEQ ID NO: 280
